United States Patent 7,745,391 (HUMAN THROMBOSPONDIN POLYPEPTIDE) - sequence listing, part 87

SEQ ID NO: 293438 - DNA, 2683 bp, Homo sapiens
taatttttttttgagtactgaaacctttattcccattttactggaaacaaagaacatgaacaatttactagtcagaaaaaaagtgttttataacccaaaacaaatatttgccaagagctgtaaattgcttaaatcgcttaaactggagatttcagtgagatttttagcagtagattactaagctccttagttatagaacattcaatgcataggaaagtgtttttcctacaaagcataactgaaatgtagtttaactaatggtttacaattcagtcaaataccaaagctgcaaaccatttagggagtcatcaattacatattttgtacactttcaaaaagcttacagctgggatgggttgtttattttcaaagcatgactgctttaaaatgatcatattctttagcctgccacctaggaagcattaagcatttacttgcagaatgaacaaacgagcacgttgtcttgtgttatgaagtatataatatagttcgttttagtttcttcattcgcagactatcaggctcatttcacgtgactgcttgcacttagaactgagttatcacggagtaggaactctccaacatcgtcgtcatagaccaagagatgcccatgaacagccatgaaagtgccagtcagggaagtattcagtgctttgttgtagagttgttggatagaggcacaggatcatttcatgttgttgaggagaaaggagcaacagcctcctcccaccttattaaaaatagagatttaaaaaaacctctaatttcctcgaagtacagaatctcaagaggtagctctaaggagaatccctctgggtttgagcgcattcctcttccagggggcctattcttggactgctttccttaatagagaaatctctctgagccaaaatcggcctcccccaattccatcctgtcggccccacttttctgctccggagacttccaagccagtccccactcctccttcagccagtcgggcccgcacccgcgcccggcagggccagccctctcctcctcctgcgtggcgcagcacaggccctgagcgcgcgaccccaggccctgggcgccccgccgcatgctcgcggctggaagccccagtttgcgtggcccttcgggttattccgctcaagagccgccgcgtcgccccatctcggcgcgaatctgaaagcgctttcgggggagaagatgttgggggcactggtctggatgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtg

SEQ ID NO: 293439 - DNA, 2955 bp, Homo sapiens
taatttttttttgagtactgaaacctttattcccattttactggaaacaaagaacatgaacaatttactagtcagaaaaaaagtgttttataacccaaaacaaatatttgccaagagctgtaaattgcttaaatcgcttaaactggagatttcagtgagatttttagcagtagattactaagctccttagttatagaacattcaatgcataggaaagtgtttttcctacaaagcataactgaaatgtagtttaactaatggtttacaattcagtcaaataccaaagctgcaaaccatttagggagtcatcaattacatattttgtacactttcaaaaagcttacagctgggatgggttgtttattttcaaagcatgactgctttaaaatgatcatattctttagcctgccacctaggaagcattaagcatttacttgcagaatgaacaaacgagcacgttgtcttgtgttatgaagtatataatatagttcgttttagtttcttcattcgcagactatcaggctcatttcacgtgactgcttgcacttagaactgagttatcacggagtaggaactctccaacatcgtcgtcatagaccaagagatgcccatgaacagccatgaaagtgccagtcagggaagtattcagtgctttgttgtagagttgttggatagaggcacaggatcatttcatgttgttgaggagaaaggagcaacagcctcctcccaccttattaaaaatagagatttaaaaaaacctctaatttcctcgaagtacagaatctcaagaggtagctctaaggagaatccctctgggtttgagcgcattcctcttccagggggcctattcttggactgctttccttaatagagaaatctctctgagccaaaatcggcctcccccaattccatcctgtcggccccacttttctgctccggagacttccaagccagtccccactcctccttcagccagtcgggcccgcacccgcgcccggcagggccagccctctcctcctcctgcgtggcgcagcacaggccctgagcgcgcgaccccaggccctgggcgccccgccgcatgctcgcggctggaagccccagtttgcgtggcccttcgggttattccgctcaagagccgccgcgtcgccccatctcggcgcgaatctgaaagcgctttcgggggagaagatgttgggggcactggtctggatgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagctcagtttccatcacctctaatcatccctggaggactcgtcctttgttcctggattaagccgggccacctgtcactcgctcaagccaagcttcccacgtggccagggacacttctgcgatcccatcagaggggaaaacttgatgtgtttcaagaatgccctggtgccaagcttctgcagagcagcacgcagaaaatgtgaagacaaaagaatgactgcccacaggaggcgcggcacagggcagaactctgctcggttgcttgtccgtgtttgaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtg

SEQ ID NO: 293440 - DNA, 2807 bp, Homo sapiens
taatttttttttgagtactgaaacctttattcccattttactggaaacaaagaacatgaacaatttactagtcagaaaaaaagtgttttataacccaaaacaaatatttgccaagagctgtaaattgcttaaatcgcttaaactggagatttcagtgagatttttagcagtagattactaagctccttagttatagaacattcaatgcataggaaagtgtttttcctacaaagcataactgaaatgtagtttaactaatggtttacaattcagtcaaataccaaagctgcaaaccatttagggagtcatcaattacatattttgtacactttcaaaaagcttacagctgggatgggttgtttattttcaaagcatgactgctttaaaatgatcatattctttagcctgccacctaggaagcattaagcatttacttgcagaatgaacaaacgagcacgttgtcttgtgttatgaagtatataatatagttcgttttagtttcttcattcgcagactatcaggctcatttcacgtgactgcttgcacttagaactgagttatcacggagtaggaactctccaacatcgtcgtcatagaccaagagatgcccatgaacagccatgaaagtgccagtcagggaagtattcagtgctttgttgtagagttgttggatagaggcacaggatcatttcatgttgttgaggagaaaggagcaacagcctcctcccaccttattaaaaatagagatttaaaaaaacctctaatttcctcgaagtacagaatctcaagaggtagctctaaggagaatccctctgggtttgagcgcattcctcttccagggggcctattcttggactgctttccttaatagagaaatctctctgagccaaaatcggcctcccccaattccatcctgtcggccccacttttctgctccggagacttccaagccagtccccactcctccttcagccagtcgggcccgcacccgcgcccggcagggccagccctctcctcctcctgcgtggcgcagcacaggccctgagcgcgcgaccccaggccctgggcgccccgccgcatgctcgcggctggaagccccagtttgcgtggcccttcgggttattccgctcaagagccgccgcgtcgccccatctcggcgcgaatctgaaagcgctttcgggggagaagatgttgggggcactggtgagtacactgcacaagtgacaaaatgttttcagctcctggaggcgaaaggtgcagagtcgctctgtgtccgtgaggccgggcggcgacctcgctcagtcggcttctcggtccgagtccccgggtctggatgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtg

SEQ ID NO: 293441 - DNA, 757 bp, Homo sapiens
ggttctgtcagcacctttcgagcaaataaggtgtgacttttcagggtactgctgcttccataagctttatttgtttactgtccagctcacagacatgtctagagacagcagtggcaagtgattaccatacttatcctagctccatctatttttgacgcttttgttttccccatcagtaaaatgggaaatatcccttatcataaagttcttgagccttttagcatgagggtggctgaaacagcataaagacttcttaatctggctgggcacagtggctcatgcctataatcctagcactttgggaggccaaggaaggaggatcacttgaacccaggagttcaaaaccagcctgggaaataatagcaggacctcgtctctataaagaaaaaattttttttaattagccaagtgtggtggcacacgctttagtcccagctacttgggaggctgaggtggaaggattacttgagaggttgcagtgagccgagactgtgccactgcactccagccagggtgacagagtgaaaccctctctcaaaaaaaataaaaataaaaagaccccttagtcttgttgtcactaagaatttatgatatgctgctgtagtaactatttccagctcttgggaaaacattaactctgtactctgatagtacagtaagtgagagtgaataagtaaggtcctatacactgaagggatagggaaaggttacttatcagtcctgttattgagactggggactgtctgattcttctcca

SEQ ID NO: 293442 - DNA, 4175 bp, Homo sapiens
tggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293443 - DNA, 768 bp, Homo sapiens
tcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtacagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293444 - DNA, 3631 bp, Homo sapiens
tggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293445 - DNA, 4066 bp, Homo sapiens
tagctgtctccagaggatccccgctcgtccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293446 - DNA, 4099 bp, Homo sapiens
tggggttataattgcctctcaccccccggaggggttattttgggggtggttggaggcggtggcggcggcggcgaggaggggaatttccttgtgcctccattcccgggaggggggagcggcgttggaggccaccgtttccagggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293447 - DNA, 2816 bp, Homo sapiens
ttaggctagtacgaggccggtgttaatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293448 - DNA, 2871 bp, Homo sapiens
tggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaacttttttttataagtctcgggtgaagtgcatctctttaggttattaaaaatgtgcaatacgctttaaaagggacataagaacgggaaatttcatcctaaggtgcgtggagttagcacaagactacaattattggggacgcacattacgtgtgaagccaagcaacagttcccttttcattcagcaccagcattgg

SEQ ID NO: 293449 - DNA, 2065 bp, Homo sapiens
  misc_feature (43)..(43): n is a, c, g, or t
aattcgccgccgcgtcgactacggctgcgagaagacgacatangggctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgcttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293450 - DNA, 2420 bp, Homo sapiens
tggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaaggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgac

SEQ ID NO: 293451 - DNA, 712 bp, Homo sapiens
tattcacttgtttgattacaggtgccacgccaaaaattatacctctcatccacaaatcttagagttgcatcatgtacaaatacttggtttctgaagaattctggactgcaagttaaagaaaatgaggaagttgaggctcagagagcaaataaacttcaaaagatcatggaggtgctaagagaggttaccataccagataaaataagaagttcaatgatttctgcatctccaaggaaaagaagctacctctaatgcctgcttcatggacctcctaccagaaaacaacagtgctctccagttcaagatgcaagattttagagtaatgtcacattcagggatttttaattcatagataccctatctaaagttacaacagagtattactgacttggctgcatttgaaaaaaactattcagaaatactcacattgaaacttacatccctcatttttgataaaggcttttgtgacagattgttagttgttttccactatgttcttccttttgtccacaggaataaaattttagctggtcacttagccacccagtgagagaatacattcctggcctcccttgaagttgttgcttggtgtggaccaatggtatgtgagtggaaattaataatgggcacaacttccaggtcatcttcaacttaaaagacaactactctaggctgggcacagtggctcacgcctgtaatcccagcactttgg

SEQ ID NO: 293452 - DNA, 652 bp, Homo sapiens
tattcacttgtttgattacaggtgccacgccaaaaattatacctctcatccacaaatcttagagttgcatcatgtacaaatacttggtttctgaagaattctggactgcaagttaaagaaaaggttaccataccagataaaataagaagttcaatgatttctgcatctccaaggaaaagaagctacctctaatgcctgcttcatggacctcctaccagaaaacaacagtgctctccagttcaagatgcaagattttagagtaatgtcacattcagggatttttaattcatagataccctatctaaagttacaacagagtattactgacttggctgcatttgaaaaaaactattcagaaatactcacattgaaacttacatccctcatttttgataaaggcttttgtgacagattgttagttgttttccactatgttcttccttttgtccacaggaataaaattttagctggtcacttagccacccagtgagagaatacattcctggcctcccttgaagttgttgcttggtgtggaccaatggtatgtgagtggaaattaataatgggcacaacttccaggtcatcttcaacttaaaagacaactactctaggctgggcacagtggctcacgcctgtaatcccagcactttgg

SEQ ID NO: 293453 - DNA, 422 bp, Homo sapiens
  misc_feature (31)..(31): n is a, c, g, or t
  misc_feature (52)..(52): n is a, c, g, or t
ggtggcggccgcctcctagaacctaggggancccccccgggctgccaggaantcgggccacgagacctgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaacttttt

SEQ ID NO: 293454 - DNA, 3568 bp, Homo sapiens
ataaatcaatacatgtaaggtatacactggtttggcctggaaaggcaggacatcttgaagatgggggtttccaggtcagaggtagatcaaagagttcctgactggcaattggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgctcagtccctctttgagagaattagttgaaacccagactctaaagtctgcttttatatttgtttgttaagaccacttatctgcagaaggttgccttttaaccccagtggttctaaggtgtggaattgagtgaccctaatatttacataagagacttgttttagtggagcataagggaggggcataagttacaccgttttgtgctgcttgagaactgtcttttaaaattgatcacaacgagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaattccatagtttaaaaaaaaatttaagcaggtagttgtggcttatctgggggcaaaataatatatgtgaaattgcttccagaggacaaagtatattttctaaagtcctgaaataggatcatgaacccttctgaagttttggtttgaaatattatagtatatgatattaccaaagagcccttaattcagagtttaaggggctctcttcctgaactctcttcatcactcagggttgaatgtgtaatgttccttgctattgattgttattgttgattcttaggatcaggccaagaatcatctggaaaacattatcttaattccgtctctcatatcctaaacagtacattttactaagaaattccatatgaaaaactccactcatgtctcctgagattatcctgtaagtgaagtagctttcatttaaccaagctaaattatttccatttagccatgttaaagagaagccaagtctagagaaagcaatcctgtaacccatgaatctggtgtacccattttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgactgaaagatgatcatgttttcttcgtaaagatttaagcaattggcaactacaaagacattattttcttactgttctatatcatgtactgttgctgacattacaaaaagggtctggaagggaaaccgtgtcactgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaacttttt

SEQ ID NO: 293455 - DNA, 1798 bp, Homo sapiens
  misc_feature (1753)..(1753): n is a, c, g, or t
ataaatcaatacatgtaaggtatacactggtttggcctggaaaggcaggacatcttgaagatgggggtttccaggtcagaggtagatcaaagagttcctgactggcaattggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgccagctcgggtgacgatataaggccatggacgcacaacctaagcggcggtgagtagaccacngtactggctccgtgagacgctcatggtccttctgtggtatacttg

SEQ ID NO: 293456 - DNA, 695 bp, Homo sapiens
  misc_feature (31)..(31): n is a, c, g, or t
  misc_feature (52)..(52): n is a, c, g, or t
ggtggcggccgcctcctagaacctaggggancccccccgggctgccaggaantcgggccacgagacctgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaactttttcactatgcacctggtaaaaaaagagttatattttaatgaacctgatttacattttaaattctttgtctttcatgtatcttccttaagaaaggtattctataagcccatatgaattatttcataatctattaagattgtgaaagttaagaagaactaaaaagaaaaaaaattgagaataagattaataatagatctttcatctgcatttaaattcatggcagagtatcatgacctgggaactgggaatggaaaaactgggtttatagtgatgat

SEQ ID NO: 293457 - DNA, 3841 bp, Homo sapiens
ataaatcaatacatgtaaggtatacactggtttggcctggaaaggcaggacatcttgaagatgggggtttccaggtcagaggtagatcaaagagttcctgactggcaattggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgctcagtccctctttgagagaattagttgaaacccagactctaaagtctgcttttatatttgtttgttaagaccacttatctgcagaaggttgccttttaaccccagtggttctaaggtgtggaattgagtgaccctaatatttacataagagacttgttttagtggagcataagggaggggcataagttacaccgttttgtgctgcttgagaactgtcttttaaaattgatcacaacgagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaattccatagtttaaaaaaaaatttaagcaggtagttgtggcttatctgggggcaaaataatatatgtgaaattgcttccagaggacaaagtatattttctaaagtcctgaaataggatcatgaacccttctgaagttttggtttgaaatattatagtatatgatattaccaaagagcccttaattcagagtttaaggggctctcttcctgaactctcttcatcactcagggttgaatgtgtaatgttccttgctattgattgttattgttgattcttaggatcaggccaagaatcatctggaaaacattatcttaattccgtctctcatatcctaaacagtacattttactaagaaattccatatgaaaaactccactcatgtctcctgagattatcctgtaagtgaagtagctttcatttaaccaagctaaattatttccatttagccatgttaaagagaagccaagtctagagaaagcaatcctgtaacccatgaatctggtgtacccattttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgactgaaagatgatcatgttttcttcgtaaagatttaagcaattggcaactacaaagacattattttcttactgttctatatcatgtactgttgctgacattacaaaaagggtctggaagggaaaccgtgtcactgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaactttttcactatgcacctggtaaaaaaagagttatattttaatgaacctgatttacattttaaattctttgtctttcatgtatcttccttaagaaaggtattctataagcccatatgaattatttcataatctattaagattgtgaaagttaagaagaactaaaaagaaaaaaaattgagaataagattaataatagatctttcatctgcatttaaattcatggcagagtatcatgacctgggaactgggaatggaaaaactgggtttatagtgatgat

SEQ ID NO: 293458 - DNA, 386 bp, Homo sapiens
caaaatgtattagagatcccattgcagttaaaggtcgatggattcaacaatgtgcagcagcccttcaaagaatacagactgtggtttcctcctgggatgacttcaccaggacccttggcaacagtgctggtggaaagtggaaagaaacagttacatgagccatagatggcagaaacagtagatagaactcacatttaggcagcaggtatatgaagccctgaaactccttgggatccctatgttcaaatgccaaagcaactgtgaccaacttttgccatatggcaaaaaaagacactctcttggcctcctttttccaccagcaatggaaaagaaaagaaataacaataataaagaaagaagaggttggtgttttcataattccaaaa

SEQ ID NO: 293459 - DNA, 1602 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaagggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggaga

SEQ ID NO: 293460 - DNA, 383 bp, Homo sapiens
gccgcctactactactaaattcgcggccgcgtcgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcggggactggtcgacgcggccgcgaatttagtagtagtagtcgacc

SEQ ID NO: 293461 - DNA, 970 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagctgtaagctttgaacaccagagtcttgaggcctatctctttctggaaggctttgtcttcctctaaaccaggaagctggagcaattccaccagattctgtacaacagatg

SEQ ID NO: 293462 - DNA, 388 bp, Homo sapiens
ctcgggagtacacgttttctgaatcttacaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcgccacactgcttttatgagctgtaacactcaccacgaagatctgcagcttcactcctgaagccagcgagaccacaagcccaccgggaggaacgaacagctccagacgcgctgcttgaggctctggactgcatcctaccaccaactcgtccaactgacaagcccccacgcg

SEQ ID NO: 293463 - DNA, 823 bp, Homo sapiens
gtatcaacgcagagtggccattacggccggggcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaaaaaaaaaaaaaaaaaaaaaaaaaaaaaaaaaaaaaaaaaaaaaaaaaaaagggggggggcgggcacgcaaaaaaatacaccccccgcgaggggggcaaccaaccggtcaacgacccgccacacgagcaatgtttatatggtagaaaaaggggagccccccaagaagaggggagctgactataattaacaagctcgagacgaacggcaggagcagcgcggcgtataaacaagacacgcggcgggcgcgcggggggcaaacccatctgggaccagcaccggggagacactctcgtgggagaaaagaaccccaccagacctctcgggggggcgggggcacaattcaagtgggcagcaaccccccacccgcccgagaagaagattatcagaagcccccagggaggcgaacaaataactaacaactggcaacggccgctcataggggggggtcgaaccacaaccgcgaaaatgatcacgcgcgacgaaaaaattggggacccgacgagaatcagatactcggaaaaataattttcccggag

SEQ ID NO: 293464 - DNA, 1920 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaagggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagactgtgcccatttcttatatgccctccctcatgtccagtccccgttctctcctcgggagcctagttgcgtgaagccggtgaggtcaagtgtaacctgacttaccggcaactaggtgaggctgatgccagatacacatgttagaggcactatttttcaggacttcccaatgtgtaatttttagatgccattatattttaatccccttcgttaccccccgtttttccttagtcatcccttttcacttctattataacatcaataatagaagtcacaaaaacaatgtaagaaagcaaggaataaaagtgatttaaacatgta

SEQ ID NO: 293465 - DNA, 1702 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaagggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagaaaaaaaaaaatccgggcttattcggggggaaaaggttgagggcaggctgtgtcgaccgttctggaaaggaaatcggcccaaggggataacaaccgccggc

SEQ ID NO: 293466 - DNA, 2456 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaagggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagactgtgcccatttcttatatgccctccctcatgtccagtccccgttctctcctcgggagcctagttgcgtgaagccggtgaggtcaagtgtaacctgacttaccggcaactaggtgaggctgatgccagatacacatgttagaggcactatttttcaggacttcccaatgtgtaatttttagatgccattatattttaatccccttcgttaccccccgtttttccttagtcatcccttttcacttctattataacatcaataatagaagtcacaaaaacaatgtaagaaagcaaggaataaaagtgatttaaacatgtaaaaaaaaaaaaaaaaaaaaaaaaaaaaaaaaaaaaaaaaaaaaaaaaaaagggggggggcgggcacgcaaaaaaatacaccccccgcgaggggggcaaccaaccggtcaacgacccgccacacgagcaatgtttatatggtagaaaaaggggagccccccaagaagaggggagctgactataattaacaagctcgagacgaacggcaggagcagcgcggcgtataaacaagacacgcggcgggcgcgcggggggcaaacccatctgggaccagcaccggggagacactctcgtgggagaaaagaaccccaccagacctctcgggggggcgggggcacaattcaagtgggcagcaaccccccacccgcccgagaagaagattatcagaagcccccagggaggcgaacaaataactaacaactggcaacggccgctcataggggggggtcgaaccacaaccgcgaaaatgatcacgcgcgacgaaaaaattggggacccgacgagaatcagatactcggaaaaataattttcccggag

SEQ ID NO: 293467 - DNA, 638 bp, Homo sapiens
ttacgatatttcggagcctcgggtaccccgataggagaccacaagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagactgtgcccatttcttatatgccctccctcatgtccagtccccgttctctcctcgggagcctagttgcgtgaagccggtgaggtcaagtgtaacctgacttaccggcaactaggtgaggctgatgccagatacacatgttagaggcactatttttcaggacttcccaatgtgtaatttttagatgccattatattttaatccccttcgttaccccccgtttttccttagtcatcccttttcacttctattataacatcaataatagaagtcacaaaaacaatgtaagaaagcaaggaataaaagtgatttaaacatgta

SEQ ID NO: 293468 - DNA, 1535 bp, Homo sapiens
ggcacgagggagagagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgtttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaagggggccgctgctgtctggtgccctgtgagctgtgattgattgcctttggtcataccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggaga

SEQ ID NO: 293469 - DNA, 3357 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293470 - DNA, 1093 bp, Homo sapiens
ctgactcactttaaatcctccgatgacaaacgtcaagcctgaaccccaggcctagggccagacgttgaagataaaatgtttccaagtcacagcctaaagctgggtgttagctaaaatgttacaaagtcacaataatgatgacagggcggtggggggtggggggtggctgttaggaccggctcccagatggcaccgtgaggcagggagaggctccaggatgctgtaggagctcccggagggccttggacagttctgctgtttgcacttgtcaaaataggcaaattcctgttcctcctggtgatgctggctgggagcgatgggggatcgcggctcctagttcagaaggaccgggctgttcctttctctctgggccttaggggggtctctctccctcctgtgtcctgaaggggaacctgcaggggaaatctgttgtgtcaggacccctaccctcagagccactgtctgctctgtcccctcaggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgcccccc

SEQ ID NO: 293471 - DNA, 1288 bp, Homo sapiens
tagcgaaggggtctcgttatgttgcccaggctagtctcgaactcctgggctcatgcaatctgcccacctctaactcccaaagtaccgagatcacagatgtgagcgaccccgcccagcctagttttagattttaaattaagcgtcctcgggattctcagagcacttggatgtggccatctcgccgccacaattctcagaagcagcagctgggccagcccctgccccgtctccgtccgtctcccactcagcggttccgtgttgtcgagttagctcgttgccccgcgccacctccttgcacacctgatgtggggctgtgggggagcagcagaggtgaggacagcctctgctgcctcagcatcgtggggttctcattgctctgaaccctcagtagctgtcgctggtgtgaggggtcagcgcagcggccatcgggggtgaaacttgtccttcgcctctcagctgtcttctacgggccttgtcttcttgactccctgcctgtctagtcatgtatgagaagacacttcccggcagtgtgtgaacaggcacctgtggtgggaacgctgctgtctctgggctggccatctagagtgttaggatcccctgttgttgtagaggatgctgcacatttgccttcctgctttgagacgctttaatgacggagacctcttagtcccacaccttcctcctcaaagcccacgcatcctgcctactgacctgggtcatcttgaccttgtgccaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggtgaggagcagcggcgcgggccctggaggtttcagagcgcttttccctgcatgactccttctgttccagtgcatgccatggggtgaatctggtgtagacgtagctttgaatttattaagtattttgtaaaagataagttgtggtcataagagagttggagctaagcaagacttcttagataatttaattggacaaaaacttaacctatatgccaactctagacacatttaattggttaattgttggtaatggctacaggaaacggaataaaattgaagcggcttcattgttctgaagccattactgcactgggatatccagagagctgaaggagggtcccgggggcccctgggctccaggtccatgggtttgcctcgcataggcctgggcttgtg

SEQ ID NO: 293472 - DNA, 898 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaatctcactctgttgccccggctggagtgcagtggtgcgatctcagctcaatgcaacctccccctcccgggttcaagcaattctcctgcctcagcctccgaagtagctgggattacaggtgctcaccaccacaccctgctaattttttgttttttgttcgtttgtttgtttttgagacggagtctcgctctgtcgcccaggctggagtgcagtggcacaatctcgg

SEQ ID NO: 293473 - DNA, 574 bp, Homo sapiens
actggaggagagactgacctgcctagggggtttgagggaagactgtggcttggcctgtggtggtcactgttgggagcctgtctggctgcaggactactccccacctgggccctggactgtgggaagtgacccctgcgggcattttgcccagtggccatcctggctgtccttttccccaccatgccctcctcagaggcgtctccctggcttcgctgcctggcgctgcttgccacgcctccttgcaggcctccatgaagagtgagtgagcgcccgctgctccagatcccctctgtgctggccccaggccggccttgagtcagtctcttgctgtctgcagggtgcacctgtccacctcccctcgaggtatcccaatgtctggagaacaggggccgaatgtcttttccatcctctgaaaatagaacttaaaaatatcatgagaaacactgttgagtataaaggcatatactccagaccacttgactctagaattttcccagagaccaactctttatgagaagcactcaggtgaattcttctaaatcaccttcatcagttattaacaccctactgaata

SEQ ID NO: 293474 - DNA, 116 bp, Homo sapiens
tcgaattcaagcttctaacgatgtacggggcatgcagtgttggggatgccttggtttttactgctctgagaattgttgagatactttactaataaactgtgtagttggaaaatcta

SEQ ID NO: 293475 - DNA, 4365 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293476 - DNA, 5022 bp, Homo sapiens
actggaggagagactgacctgcctagggggtttgagggaagactgtggcttggcctgtggtggtcactgttgggagcctgtctggctgcaggactactccccacctgggccctggactgtgggaagtgacccctgcgggcattttgcccagtggccatcctggctgtccttttccccaccatgccctcctcagaggcgtctccctggcttcgctgcctggcgctgcttgccacgcctccttgcaggcctccatgaagagtgagtgagcgcccgctgctccagatcccctctgtgctggccccaggccggccttgagtcagtctcttgctgtctgcagggtgcacctgtccacctcccctcgaggtatcccaatgtctggagaacaggggccgaatgtcttttccatcctctgagagctaagcataatgccaccgtgtcttcagtagggtgttaataactgaggaaggtaatttagaagaattcacctggtgcttctcataaagagttggtctctgggaaaattctagagtcaagtggtctggagtatatgcctttagactcaacagtgtatctcatgatatttttaagttctattttcagatgttgtgataacctacaactttctgttaaatgttagtcattctgatgagtaaaaagttcagaatggttgttgggtagggagagagaaggcacaagggtcttcagtgggattgggaaggtattatttcttgaggcaggttgtggtaaaaggtatttgttttaatcgtttttaataacttttgtgtatgttttgatatttagtatttgatcaaactccaagcaactggattcatggccattgtgagcttgcactttgcagcaggagagctgactgcatctgtgacggctcggacggcctgggacggtcgtttcttttctgagacagggtcgttctctgtcacccaggctggagcacagtggcgcgatcacgactcactgcagcttcaacctcccgcctcagcctcccaagtagctgggaccacaggcgtgcaccgttgtgcccaggtctaagtgtttcgatttagaaatggtttcctcttatctcaggtgggaaccactcctgctcctcactgaagtgacctcagcgaatgaagtgtgggtgacctcgaacagcacagcattagtctttgtctctgataacgtcagggaagaattggaggaagtgcaggatcttctgtgcaggacgctgcccctccccgtccagctgagctttcctgaggaagctctggatgtcgcccgtgtctgttgctcatgtgtttgtttctcccttttgcttctctgccggctcagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293477 - DNA, 4580 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgccccccaaaaataaaaataataaaaactaaaaatgtcttgccagcctgggtgtggtgggctcagcctagccccagcctcatgggggctgagctccagccgctgactgtgggccggaggctgctgccgcccgtggctgtggagggacagccgtgctttcagcgcacagggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293478 - DNA, 4070 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggtgtcaaacccctggcctcaagtgatccccacccacctctccttccaagagcgttctcttttttttttttttgagacagtctcactctatcccccaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293479 - DNA, 3667 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggtgtcaaacccctggcctcaagtgatccccacccacctctccttccaagagcgttctcttttttttttttttgagacagtctcactctatcccccaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293480 - DNA, 4122 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293481 - DNA, 4125 bp, Homo sapiens
actcaacaagctttccagctcttggcgtcagctctagacctaaggcggacggaggaaggggtcggggtggcggaggaccccgcgcgcctgggagcccacgagggaccctgcccgggcccggagggcggaccctgaagagaacagagcctcttcctaagcttccagacggcgcctccccgcttcctacgatgggctcgcgcagcggccggggcaggaccgaggctcgaagcgcctccgagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293482 - DNA, 3557 bp, Homo sapiens
ttaggctaggtagaggcggggttaatcggccgagggtcaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293483 - DNA, 3517 bp, Homo sapiens
tgcaacctccgcctcccgggttcaagcgattctcctgcctcagcctcctgagtagctgggattacgggtgcgcgccaccacacccagctaatttttgtatttttagtagagacggggctggtctcaaactcctgatctcaagctacgcgcctgcctcagcctcccaaaatgttggaattccaggtgtgagccaccgcacctggcctgcaagaagtttttaaaagtagctgggcgtggtgccacatgcctgtatattcccagctactcgagaggctgaggtgagagggtggcttgaacccaggagtttgaggctgcagtgagctatcatggcacccactgcactccagcctgcgtgacccagagagaccttacctctaaaaaacaaaaaaacggaatccccaagtagttagtgttgcattgtctgctgccgtccagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293484 - DNA, 3574 bp, Homo sapiens
tttgtatttttggtagagacaggtttcaccgtgttagccagggtggtctcgatctcttgacctcgtgatccgcccatctcggcctcccaaagtgctaggattacaggcgtgagccaccatgcctggctgagtaattttttttaaagcaaattgctagataagtttcttactaattaatgacgaaacatttcccttctgtgcttgaagactgactgtgagcctcgtcagcctgacatgagtgaagccttgggatcctaggatggagacgtggggttggggcggctcaggtgcgtgggctgagcgctggcatcgtgctgctgatttcctgacttcgcccagctccttgcactttgttctttctgcacaaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293485 - DNA, 3052 bp, Homo sapiens
atgcaaagaaaccagatcccttgtacgctgctgatgggggtgtgacgtggtgcagcctcactgggaaacagtttggcagcttcttaaaaaactaaacgtgtgctcaccatgtgaccccgtgtccacatgcgctcaccacatgaccccgcatccaccctcctgggtgctcatcccaggaaagcaaagacttaggctcacacgaaatgcctgggcgccgacgctcatttacctgtaatagctaaaaactggaagtgacccaggtgccattcagtggctgagagctgaaactggtgtatccttatcacagtgttctacgcagaaatagaagagctgaaactggtgtatccttatcacggcgttctacacagcaactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293486 - DNA, 2782 bp, Homo sapiens
gaaccttgtaataacgtgcacgcaccagtcatagatgtcgctgatccaatactcgagttcatatacccctattgtgtattatgaactctatattaggacaggacagttcctatcttgcgtccgctattccgggttcgtatttacagcgataaaagtccttcgtaatccgctttcacacgcgggattcctccgaggtcggttctctatctattgtccaatattcctccctctgtgtaaatttttttctccctatatgaacattcgtggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293487 - DNA, 3303 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293488 - DNA, 3208 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293489 - DNA, 2224 bp, Homo sapiens
ggtggcgaactcggcacgaggcacaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293490 - DNA, 3439 bp, Homo sapiens
ctgactcactttaaatcctccgatgacaaacgtcaagcctgaaccccaggcctagggccagacgttgaagataaaatgtttccaagtcacagcctaaagctgggtgttagctaaaatgttacaaagtcacaataatgatgacagggcggtggggggtggggggtggctgttaggaccggctcccagatggcaccgtgaggcagggagaggctccaggatgctgtaggagctcccggagggccttggacagttctgctgtttgcacttgtcaaaataggcaaattcctgttcctcctggtgatgctggctgggagcgatgggggatcgcggctcctagttcagaaggaccgggctgttcctttctctctgggccttaggggggtctctctccctcctgtgtcctgaaggggaacctgcaggggaaatctgttgtgtcaggacccctaccctcagagccactgtctgctctgtcccctcaggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgccccccaaaaataaaaataataaaaactaaaaatgtcttgccagcctgggtgtggtgggctcagcctagccccagcctcatgggggctgagctccagccgctgactgtgggccggaggctgctgccgcccgtggctgtggagggacagccgtgctttcagcgcacagggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293491 - DNA, 1610 bp, Homo sapiens
ccttatctcggatcgtggacgcaggcagataattggtctgtggtaccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293492 - DNA, 2572 bp, Homo sapiens
atatgctttgtaaacagatcctgaaggcagcatgctcgttaagagtcatcaccactcccttatctcaagtacccagggacacaaacactgtggaaggccgcagggtcctctgcctaggaaaaccagagacctttgttcacgtgtttatctgccgaccttccctccactattgtcctatgaccctgccaaatccccctctgcgagaaacacaagaatgatcaattaaaaaaataaaaataataaaaactaaaaatgtcttgccagcctgggtgtggtgggctcagcctagccccagcctcatgggggctgagctccagccgctgactgtgggccggaggctgctgccgcccgtggctgtggagggacagccgtgctttcagcgcacagggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293493 - DNA, 2018 bp, Homo sapiens
tagcgaaggggtctcgttatgttgcccaggctagtctcgaactcctgggctcatgcaatctgcccacctctaactcccaaagtaccgagatcacagatgtgagcgaccccgcccagcctagttttagattttaaattaagcgtcctcgggattctcagagcacttggatgtggccatctcgccgccacaattctcagaagcagcagctgggccagcccctgccccgtctccgtccgtctcccactcagcggttccgtgttgtcgagttagctcgttgccccgcgccacctccttgcacacctgatgtggggctgtgggggagcagcagaggtgaggacagcctctgctgcctcagcatcgtggggttctcattgctctgaaccctcagtagctgtcgctggtgtgaggggtcagcgcagcggccatcgggggtgaaacttgtccttcgcctctcagctgtcttctacgggccttgtcttcttgactccctgcctgtctagtcatgtatgagaagacacttcccggcagtgtgtgaacaggcacctgtggtgggaacgctgctgtctctgggctggccatctagagtgttaggatcccctgttgttgtagaggatgctgcacatttgccttcctgctttgagacgctttaatgacggagacctcttagtcccacaccttcctcctcaaagcccacgcatcctgcctactgacctgggtcatcttgaccttgtgccaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293494 - DNA, 3657 bp, Homo sapiens
  misc_feature (3614)..(3614): n is a, c, g, or t
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatctaaaaaaaaaaaaaaaaactcgagtttttttttttttttttttttaaccagaggtggaatctttatttcacaagtttcaagatacagtacaaaacgattctgtacatctctctattaacaggatttgtttacacaattatattacacttcaccaacctttatactgcatttcattaaatacaaaatacatttacaaaaagagtctaccatggtgttccttcacaatgccagcttaaggtcttttatgagttttatgagnttattttctaatcaaagagaatagtgtcagcctgtttctcaac

SEQ ID NO: 293495 - DNA, 744 bp, Homo sapiens
atcggctcggccctgctttcgtcgggtgaatagcaactcaggcaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 293496 - DNA, 3249 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagccgcacatgggtcatattcgcgactcactgcaggcgtcagggattgcgccggcaggatgcacacaggaaagcgctctgatcacaaatacgaatt

SEQ ID NO: 293497 - DNA, 3166 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgggtgtttatcgatgccacagactgagagaaaatatgggcaaaaagtgtatatgataaataactgttatttaaaatatacaaagaactcttaaaactcaacaataagaaaacataaaacccagtat

SEQ ID NO: 293498 - DNA, 2503 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgaaatcttctgtatcctcgctcaaaaa

SEQ ID NO: 293499 - DNA, 2324 bp, Homo sapiens
  misc_feature (2291)..(2291): n is a, c, g, or t
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggccaggacgactgggaggtcccgtggctatcctggggaccttggtgggcctggtggncctctcccggggcggggcagggagggggccctg

SEQ ID NO: 293500 - DNA, 3343 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgccccccaaaaataaaaataataaaaactaaaaatgtcttgccagcctgggtgtggtgggctcagcctagccccagcctcatgggggctgagctccagccgctgactgtgggccggaggctgctgccgcccgtggctgtggagggacagccgtgctttcagcgcacagggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagctttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccagtaagctgaacaggggagatttaatgcaaacatttgtccctggctgggcactgtggctcatgcctgtaatcccagcactttgggggctgaggcgggagggttgcttgaggccaggagtttgagaccagcctgggcaatacagcaagaccccatctcttaaa

SEQ ID NO: 293501 - DNA, 2234 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgcccccc

SEQ ID NO: 293502 - DNA, 1911 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatgtgttctacgcagaaatagaagagctgaaactggtgtatccttatcacggcgttctacacagcaactagaagagctgaaactggtaaatagaagagctgaaactggtgtatccttatcacggtgttctacgcagaaatagaagagctgaaactggtgtatccttatcacggtgttctacgcagcaatagaagagctgaaactggtatttacctaagagtagacgctcgtccaacagaaataaaaaatgccttgccaaagaaagtgaaaaaataaaaataaaaaatgcccccc

SEQ ID NO: 293503 - DNA, 1824 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttgtaagttctgtaaatcagagctctctgaactctttctggtttgtgtttgctgaatacttttcccataagctatacgatgaatacacagggaaaacctgttgcagagagtagcctgaagccacaattagacagcagctcaccttcctttcccatggtccggctgtaaggcgtgtagtaaccaatgttgcctgagggcctctcacccctaactctggggtgcctgagccttgtgagattacagggcagttgaatctgcgtttttcttttctttttttttgagacggagtttcgcccttcttgcccaggctggagtgcagccgtgcgatctcagctcaccgcaacttgcacctcccgcattcaagcaattctcctgcctcagcttcccgagtagctgggattacaggcacgcgccaccacgtccagctaattttggtatttttggtagagacggggtttctccatgttgttcaggctggtctcgaactcccgacctcaggtgatcctcccgcctcagcctcccaaagtgctgggattataggcatgagccactgcacctggcctttcttttattgtgtgtgtgtgtgtgacagagtctggctctgttgcccaggctggagtgcagtggtgcgatctcagctcactgcaacctctgcctcctgggttcaag

SEQ ID NO: 293504 - DNA, 1937 bp, Homo sapiens
cgaccacgcagccacgacccggccggttattcacccgccaggccctgggaatacaaggccggcttcaaaaaaaccagggcacccgcgacctcctcgcagacgcgcgcccccatacccgggcctcaggcagccacgaggtagacgggctcaggctcgggggtgcggcaagcggcacccgggcgcggcggggcgcagctgtggggaccgcgcaggcgccacgtcagaccccgcccaccccgccgcgcaggcgccgtgtagcgccccgcggatcacgcaggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaagtatgttggatgtatttgttgatgcttgaactaaacctaacttggctttgtaatctgagaaacagattgcaatcaaaaatctcaaactgtctttgcctatagttaactagactttttagtgggagggttaaataaatatagaagtgaatgatacaatgccaggagatttggaaatatagttatccctgggtatccatgggggctggttctcggacttcccaaggataccagcacctgaggatgcctaagcccctggtgtaggatgctgaagtctaagcccctgatgtagatgccgaagtctcagcccccgacgtaagatgccgaagtctcagcccccgacgtaggatggcgaagtctcagcccccgacgtaggatgccgaagtctcagcccccgacgtaggatgccgaagtctcagcccccgacgtaggatgccgaagtctcagcccccgacgtaggatggcgaagtctcagcccccgacgtaggatggcgaagtctcagcccccgacgtaggatggcgaagtctcagcccctggtgtaaaatgccgaaatctttgtgtgtaacctaagaacattctctgatatgctttaaatcatctgtaggttgataataatacccaataccctgtaaatactatttcaatcgttgttatactttagggaataatgacaaaaatgtgtctgtgcatgttgagtatagatgcacgtttttccccagatacattcattctgtgcttggttaaacctgcagagatgaaacctgtggctgtggaggccaaccgtgtgcaagtccgttggagtttgtttagtcactttctttagttgtgtggcgcttctgaattcacattcttgtataattttcactgactgtgctctttgatgaa

SEQ ID NO: 293505 - DNA, 477 bp, Homo sapiens
aggggtggccaggggcccccgcgagcagctgccgtgtgtctgtttgtagggaatggagctggtagctttagttgtccttggtgtagaactttgtctggcccgggtacaggaagaggctttgttttttattaactgcccatttcctgattctctctgtgtcccctcaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtcagtgctcgtgcgccccgcacccccattgcaccatcagaggaggttttccgatgtctttcagaacaggttgtggtgagccaagatcgtgtcactgcactccggcctgggtgacagagtgagactctgtctcaag

SEQ ID NO: 293506 - DNA, 1067 bp, Homo sapiens
gcagagccatggcctcccacctgcgcccgccgtccccgctcctcgtgcgggtgtacaagtccggcccccgagtacgaaggaagctggagagctacttccagagctctaagtcctcgggcggcggggagtgcacggtcagcacccaggaacacgaagccccgggcaccttccgggtggagttcagtgaaagggcagctaaggagagagtgttgaaaaaaggagagcaccaaatacttgttgacgaaaaacctgtgcccattttcctggtacccactgacaattcaataaagaagaacacgagacctcaaatttcttcactgacacaatcacaagcagaaacaccgtctggtgatatgcatcaacatgaaggacatattcctaatgctgtggattcctgtctccaaaagatctttcttactgtaacagctgacctgaactgtaacctgttctccaaagagcagagggcatacataaccacactgtgccctagtatcagaaaaatggaaggtcacgatggaattgagaaggtgtgtggtgacttccaagacattgaaagaatacatcaatttttgagtgagcagttcctggaaagtgagcagaaacaacaattttccccttcaatgacagagaggaagccactcagtcagcaggagagggacagctgcatttctccttctgaaccagaaaccaaggcagaacaaaaaagcaactattttgaagttcccttgccttactttgaatactttaaatatatctgtcctgataaaatcaactcaatagagaaaagatttggtgtaaacattgaaatccaggagagttctccaaatatggtctgtttagatttcacctcaagtcgatcaggtgacctggaagcagctcgtgagtcttttgctagtgaatttcagaagaacacagaacctctgaagcaagaatgtgtctctttagcagacagtaagcaggcaaataaattcaaacaggaattgaatcaccagtttacaaagctccttataaaggagaaaggaggcgaattaactctccttgggacccaagatgacatttcagctgcc

SEQ ID NO: 293507 - DNA, 417 bp, Homo sapiens
ctgagttgcctttggcctgtaactccaatgatttgcaggtagggagtatagagctgctatctttaatgtagatttataattacctccgctgtctctcaaattctaagtcattgggactggagtactggctctatacagttccttggtttcagagctttattactaacaagactgtatctcctttaatccctgaactctcatctctcccagcttctgaactgttacaataccaaacaataaagttatttaactttaagtcactctttggagactggatatagtcaggtacagtgaaagtctgaggggtggtgaactctggtgagtggcactgaggagaggacaggggtacttccagaagtaagctcagtgacactctgacttgaaacctttttcttccttcccagacccagaacgctg

SEQ ID NO: 293508 - DNA, 810 bp, Homo sapiens
agcgggagatccgagcgtctcggctggtggaaggggcgaggagctttgcagttgtgtgcgagtgtgtacagggacagagtcctgagcaaggaaacctagaagggagagaggaataccatggaattgagtcctgtctggtagcactgacagacacagtggccagccaccctcatgccaccctgtcctgccatgggaaggaacagcagctctagagttcctatgggaactctctttccttctcactgaactctagcttcatcaataactcagtgcctctggccaagtttttagcctctgggacaacatccactatatccatatgaggcactcatgtaacacggtgattaagagtacagatgctgaagccagcagcctaagtctgaatcctgactgccaattattaatataagttgtggaaccatggtcaagttactcaacctctttatgcctctgtctcctggtctacgaaatgaagctttgaatctgctgttattaagttgctggtgctgaaataacacttattatttatgatctaactgaaatgggaacactggaaacttctttgaaactgaagaaaaaaatgaaaaagaagtttttacaatcaaaactgccatgaagactgctttacccaaaattttggtccacagctttcattgaattacttatcagggcaaacaaagtttagccatgtgaacacgttccaattttgttggaaataatttggatccagctatctttatacaatggtgagttcgtattgcatctcatggctaaaatactgaggtaaaggcttttggatctttgtgtgtg

SEQ ID NO: 293509 - DNA, 1817 bp, Homo sapiens
aagcttacgaggaattcttggatgacatccctcagcatgtctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293510 - DNA, 844 bp, Homo sapiens
tacgtagtagagcctggtggttaatcgcccgagggagggcaaagagcgcgcgctccccacgtcctgcgctcctggctgccgggcattcgtctcagccgtgactctcgcccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtgcgtggttgctggacaatgactagcaccttgtaaccggattgccactggatcgcctgccacatacagaacccggccttgctaccagatccaaccggttggtgttcacatcgatggtcggcagtcgcatcacctgcg

SEQ ID NO: 293511 - DNA, 1828 bp, Homo sapiens
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293512 - DNA, 2137 bp, Homo sapiens
  misc_feature (2095)..(2095): n is a, c, g, or t
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtataacacacacaccagaaaaaactctggaaatagttctctttttcccccgaggtagaaattccggtgccttttaaggcggccaccaaccttaagggggctccccgttggaaggggtgtggcttccctttatgcaacaggggtggcacaaaaaccgtgtttgtcgcgtggcgctgttctgtgacccctctgggcgtgtacatgaccgcgggtggcacataagacacggtggtgaaaaattggctccgccccattatatgattggtgaccgnccgcacccaaaaatattgttggcctaagaaaaatatgctcgc

SEQ ID NO: 293513 - DNA, 1844 bp, Homo sapiens
aagcttacgaggaattcttggatgacatccctcagcatgtctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagctccagaacagctccagagtgataaagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293514 - DNA, 1957 bp, Homo sapiens
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtatatcagtatagccagggcttgatctgtgaatacgggggggtggtgaaggggtccagtttctaggcatctgacagtagggtggccttcacctcctccaacgtcttatcacttagtccaaatcttagtgtgtt

SEQ ID NO: 293515 - DNA, 1737 bp, Homo sapiens
aagcttacgaggaattcttggatgacatccctcagcatgtctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293516 - DNA, 1874 bp, Homo sapiens
  misc_feature (1857)..(1857): n is a, c, g, or t
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtataagaaattctcatgtgcaaaaggcaggagnacagacgaggcagggtt

SEQ ID NO: 293517 - DNA, 1435 bp, Homo sapiens
ttgtaattcagatgcttcttgatttaagatgggattatgtgctgataaacccatcataaagccaaaacatcttaaattaaaccatcctaagtcagggacagtctgtaggtagtccagaattgaagtgaattagtggatacccagctggcatctactgtagaattgactgcttacctgatgtgtgtggtaagaccccacccatctggtatcagaattgtgttgtgagagtgtggcaggagaaactgagtctgtttattcctgtatacacacagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293518 - DNA, 1783 bp, Homo sapiens
aagcttacgaggaattcttggatgacatccctcagcatgtctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccaggtgtcctagcgaccattccagagacctttgatattcccatccagagggtgagaaaattcatgaagacatctttgacatcatagaccgagaagcagatggaagtgacagtttggaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293519 - DNA, 1707 bp, Homo sapiens
ttcagcaggatccccttcgactggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagccggttggtcagaggcacagataaaacaacctgaagcttgtgttggcattggaagtgggagagtcttgtgggactgagccttcactctgtgggatctgatgctatcttcagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293520 - DNA, 1946 bp, Homo sapiens
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcggtgagtctaggtttctattcttcttagaagagtctgttccactggccaccttcatcatcttccccaagttcactcctaaccccctggctcgcattttggagattttcatctctttcagctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293521 - DNA, 1238 bp, Homo sapiens
gggaggggatctacagagtttgaagctttcaggcttatcctttttggctctgaagactcagttctgccctcaccccttttgtacaaaatggcacatatgggcagtgatggaggggtccttccggttcactatgccaccatcctcttttctctcaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293522 - DNA, 1129 bp, Homo sapiens
ccaccggcaggttgtactcacggcagatggtagtgaccgtttggaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293523 - DNA, 1550 bp, Homo sapiens
ttgtaattcagatgcttcttgatttaagatgggattatgtgctgataaacccatcataaagccaaaacatcttaaattaaaccatcctaagtcagggacagtctgtaggtagtccagaattgaagtgaattagtggatacccagctggcatctactgtagaattgactgcttacctgatgtgtgtggtaagaccccacccatctggtatcagaattgtgttgtgagagtgtggcaggagaaactgagtctgtttattcctgtatacacacagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgggcccccactcccggactcctttggactggaagccctccttgctggagggtcatctggggaaggaaggtcccacccaggccgagccccatgacatggcacgcctgtccccaggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293524 - DNA, 1332 bp, Homo sapiens
atgtttttacaaaaaatcaggtttggtatctggtccggaattcccgggatgctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 293525 - DNA, 838 bp, Homo sapiens
aagcttacgaggaattcttggatgacatccctcagcatgtctgagcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccaggtgtcctagcgaccattccagagacctttgatattcccatccagagggtgagaaaattcatgaagacatctttgacatcatagaccgagaagcagatggaagtgacagtttggaggtgaagttatggagtgggggaaggaatgggcagggaggccgaagagtgctggggacaggtcaggaggtggcctggataggtaatatgaggggagcaattcaattcctttgttctcaaggaagtcataaatctgaatgg

SEQ ID NO: 293526 - DNA, 585 bp, Homo sapiens
gtaggggaggccccttcatcccgcgccctggacctgcaggggtagaggagaggccacctccactgctcctatgcccaccccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcggtgagtctaggtttctattcttcttagaagagtctgttccactggccaccttcatcatcttccccaagttcactcctaaccccctggctcgcattttggagattttcatctctttcagctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctc

SEQ ID NO: 293527 - DNA, 319 bp, Homo sapiens
ggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagagtgagcaagcgagcgccggccccgccggtctctggttctgccccttcgggtcccacccaagtgcctggcttccaccagtccccctttcccttccatgaaccccctgccctgctgc

SEQ ID NO: 293528 - DNA, 643 bp, Homo sapiens
ttcaaccaaacctgagcttatgttaaagaggcgatttttggaaagtcccagatagccactggatggggggctggttgccaggggaacaaacctggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagccggttggtcagaggcacagataaaacaacctgaagcttgtgttggcattggaagtgggagagtcttgtgggactgagccttcactctgtgggatctgatgctatcttcaggtacagatactcctcaacttacaatggg

SEQ ID NO: 293529 - DNA, 383 bp, Homo sapiens
aaactaacaaacctacttcctggctttggagttcagcaggggctaagccaatatcttatttctatgcccattttatcctcaagatgctgtgatgctcttctgtccccccaggtggtgctggacaacacagccctgaaccggattgccacagaccgcctgcacatccagaacccgtccttctcccagatcaaccagctggtgggcccccactcccggactcctttggactggaagccctccttgctggagggtcatctggggaaggaaggtcccacccaggccgagccccatgacatggcacgcctgtccccaggtgtccaccatcatgtcggccagcaccaccaccctgcgctaccccggctacatgaacaatgacctcatcg

SEQ ID NO: 293530 - DNA, 2076 bp, Homo sapiens
acatgcgtcccgagcccgccagaagctgctaggctgaggctgctgtcccggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgcactcactgagtaacagctaatctttaatataatattatactgctatatttaaaaagctgactacttgatataatta

SEQ ID NO: 293531 - DNA, 804 bp, Homo sapiens
cgcatcttgctcccatcaggatatattccagaaatgctaagtgttgatcaacattaggaaatctgtgaatataagtgagagcactgtagcagttgaaaggttagattacatgaccatcttgatagacgctgaaaaggcatgataaaattggttttttgatttaaaacaaacattagcatacaaggatgaataaaaaagaatctgaacatgataaaacatggttatcagaaacaaacagccaatactagagacacttaaccttagtccacaggaacctgatgggacgaagagcgcccccatcagcatcttggataactctaaagaaaatttagtgttatattctaaggaataatcctgccatatttcttggctctgacctgatgaattgttttaatttcttggggtgagggcagtgggtgaactgttttaattttgtcttcagtaactttgtttctaaattgtgataatctgtaggcagaactccattataacagttaatggagttatcaaaagttcttttaggctgggcgcagtggcttcatgcctgtaatcccaccactttgggaggccgaggtgggtggatcatttgaggtcaggagtttgagatcagcctggtcaacatggtgaaactccatttctactaaaaatacaaaaattagctgggcatggtggcacatgcctatagtcacagctactcgggaggctggggcaggagaatcgcttgaacccaggaggcggagattgcagtgagccgagatcacgccattgcactccagcctgggcgaccgagcaagactccgtctc

SEQ ID NO: 293532 - DNA, 587 bp, Homo sapiens
tgcgtccatcagtagtaaaaaccggttaatttttaccctttgcaggaattgctgatgggagcaaactgcgcgcatccccccatcagcatcttggataactctaaagaaaatttagtgttatattctaaggaataatcctgccatatttcttggctctgacctgatgaattgttttaatttcttggggtgagggcagtgggtgaactgttttaattttgtcttcagtaactttgtttctaaattgtgataatctgtaggcagaactccattataacagttaatggagttatcaaaagttcttttaggctgggcgcagtggcttcatgcctgtaatcccaccactttgggaggccgaggtgggtggatcatttgaggtcaggagtttgagatcagcctggtcaacatggtgaaactccatttctactaaaaatacaaaaattagctgggcatggtggcacatgcctatagtcacagctactcgggaggctggggcaggagaatcgcttgaacccaggaggcggagattgcagtgagccgagatcacgccattgcactccagcctgggcgaccgagcaagactccgtctc

SEQ ID NO: 293533 - DNA, 1538 bp, Homo sapiens
acatgcgtcccgagcccgccagaagctgctaggctgaggctgctgtcccggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgcactcactgagtaacagctaatctttaatataatattatactgctatatttaaaaagctgactacttgatataatta

SEQ ID NO: 293534 - DNA, 2179 bp, Homo sapiens
acatgcgtcccgagcccgccagaagctgctaggctgaggctgctgtcccggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggtctgtgatgtgtatttacaaatgcagatcttcttccattttaagttcagaagttactttcattaattttggcagagtaaacagcatgacccttaagtaagactaagcatagattgagggccagaattgttgacatattttctataaaagatctttactaaggcttgtttcagttaaagcacctgcaaaatggggcatttacacaaatctcacttctccacttcccccatcagcatcttggataactctaaagaaaatttagtgttatattctaaggaataatcctgccatatttcttggctctgacctgatgaattgttttaatttcttggggtgagggcagtgggtgaactgttttaattttgtcttcagtaactttgtttctaaattgtgataatctgtaggcagaactccattataacagttaatggagttatcaaaagttcttttaggctgggcgcagtggcttcatgcctgtaatcccaccactttgggaggccgaggtgggtggatcatttgaggtcaggagtttgagatcagcctggtcaacatggtgaaactccatttctactaaaaatacaaaaattagctgggcatggtggcacatgcctatagtcacagctactcgggaggctggggcaggagaatcgcttgaacccaggaggcggagattgcagtgagccgagatcacgccattgcactccagcctgggcgaccgagcaagactccgtctc

SEQ ID NO: 293535 - DNA, 879 bp, Homo sapiens
ttccccttcctttgtttccctcaagaggccactggagcattacatgactttctttctttaactctgcctgtgataagcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgtgagtatgaatcctaagtgtggagtctcctcttaactccttctggtctgataccagtatatgaagtagagctggcctttgaaaatgctggactcaaaggggtgggtcaacagttctcagggcctttatcctagtctcttacatttagatgagatagtttttccactagaaatccacttggtagtaagcaaatgacttgccctttgtctcttaaatagcccttcagatataagccatttggattttcattaatattatcattatcattattattatcattattcagtagctggcattcctcatgataatttggccttctttggtttgtatcttacagcccagattatgagatttaatttaatttaatttaagttgacagaagtgtctgtcagagaaagcaagtagaaaatcatttttttggtggtggttctaaagcagttattcctaacttttcaaggggtgttgggacttttttgaaaccaatagaatcattttaagaaaatgcccatgtataatttcaagttcacagaatctctgaaaccatacatgagtttgggtatgcttgtgtatataccagattcctgctctagagtatatgactt

SEQ ID NO: 293536 - DNA, 545 bp, Homo sapiens
ataatgaatgcttatgatctttatttaggaacatgacagtctcaagccctctgtcacttctaagtcttgatgatttgtctcatttgcccagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgtgagaaaactgttttgttattgtcttcatttcatacagtttttcaaataccacatttataagctacaatgaagtgtgactgaagtagcacaaatgtgcctgcctaacgcaactgcgagactggaacaataaatgacaaaaattagtgtacttgctagttggggatgccattgcaggccttgatacctcaagaggaaatggtcatgagagacaggatagcccagcggctcacatgtttgaaca

SEQ ID NO: 293537 - DNA, 710 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgagggggtgaactatatagattgacccacattctttcacacagtttctgttatggccaaaatttgggagaccagaaaagaccttggggaaacttgaaggac

SEQ ID NO: 293538 - DNA, 2832 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctattttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttg

SEQ ID NO: 293539 - DNA, 2585 bp, Homo sapiens
acctggtaactagcagaacctaaaacatctgaaaaaggcaagcacaagttctctgatactgcattgtgctccctttatgagtgctttgtccatttatgcccaaggttgcaatgttttgaatttttgcaatcagaccttggcaatgactttgagcagtaggatataaataactcccacatgcttcgcgttccaataatggaacactaggcataaatgggttagagtgagaggataatagcatctctttaatggaaagaatattactgtaactctattctgaagactccattttgagtgctctttgtgtttatagaataaggtagaaatatttttgctgttaattgaccctacagggcattctaaaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctattttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttg

SEQ ID NO: 293540 - DNA, 2066 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgtaagtcaggatacttgcatgctgttactttgtactgatgtgtagttaacaggatgtcacatagtagtacaagagttataaaagacccttcatggcagtatatactgcaaacaaggctagttgtcatttcaaaaagtgaaaatttggtcttctctaaccccattactatatttaacagtggctgatattagaactattgtaaaataggaacatatagcacttgtatgtctagagccaattttaacatttgctttcattatcttgggtgaaaagaaatgatagatttcagtttggcattttctaatttgtaacacagctagacaaaacagagcctttctgttctgtgtgttggttaattttttcctttaatcagaaaattaacaatatattcttgatataatgcaacatttgtttttggtaccatttgaccatactgtacaagatatgagaagatttatttcaatagaaaatataagtactgaaattgaattaggctacttttaataaagaatgatttatgggaatacagaactagaaaagcatcacaaatcctactccatcaatatcaaaacagttacttgttcaagatatcaatataaaaaggaataaatattaacaaatataaattt

SEQ ID NO: 293541 - DNA, 2188 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctattttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttg

SEQ ID NO: 293542 - DNA, 2348 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgtaagtcaggatacttgcatgctgttactttgtactgatgtgtagttaacaggatgtcacatagtagtacaagagttataaaagacccttcatggcagtatatactgcaaacaaggctagttgtcatttcaaaaagtgaaaatttggtcttctctaaccccattactatatttaacagtggctgatattagaactattgtaaaataggaacatatagcacttgtatgtctagagccaattttaacatttgctttcattatcttgggtgaaaagaaatgatagatttcagtttggcattttctaatttgtaacacagctagacaaaacagagcctttctgttctgtgtgttggttaattttttcctttaatcagaaaattaacaatatattcttgatataatgcaacatttgtttttggtaccatttgaccatactgtacaagatatgagaagatttatttcaatagaaaatataagtactgaaattgaattaggctacttttaataaagaatgatttatgggaatacagaactagaaaagcatcacaaatcctactccatcaatatcaaaacagttacttgttcaagatatcaatataaaaaggaataaatattaacaaatataaatttaagtatgcttggggtacatttatacttccatttttttgaggacaaattatacttccacatttttaaagacattaagtgaataataattcatagtctttggaattttccctttatggaagcataatttaaaatgtagtaaggttcttatatttcttgcaagagaatcttctagttgtgataagaattatcagaacagttgaggagtaaccccactttgctttggccttcaaatagctctcccctgaacttgtcaatttactgagtatcctctgtatctgaatg

SEQ ID NO: 293543 - DNA, 2239 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgtgagtatgaatcctaagtgtggagtctcctcttaactccttctggtctgataccagtatatgaagtagagctggcctttgaaaatgctggactcaaaggggtgggtcaacagttctcagggcctttatcctagtctcttacatttagatgagatagtttttccactagaaatccacttggtagtaagcaaatgacttgccctttgtctcttaaatagcccttcagatataagccatttggattttcattaatattatcattatcattattattatcattattcagtagctggcattcctcatgataatttggccttctttggtttgtatcttacagcccagattatgagatttaatttaatttaatttaagttgacagaagtgtctgtcagagaaagcaagtagaaaatcatttttttggtggtggttctaaagcagttattcctaacttttcaaggggtgttgggacttttttgaaaccaatagaatcattttaagaaaatgcccatgtataatttcaagttcacagaatctctgaaaccatacatgagtttgggtatgcttgtgtatataccagattcctgctctagagtatatgactt

SEQ ID NO: 293544 - DNA, 1306 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaaggtaaatcccagccaaagatcttttttcctcacaaaggaagcagttaaactagtgataatgtgctccagagcattttagattcatttccacctgtgccctcttgcaccttgttttctgcttagactgtaactcccttttgaaataaagcaccctgtatctctgtcattgtttggcccc

SEQ ID NO: 293545 - DNA, 1138 bp, Homo sapiens
gccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcaggtaagatacagggctgggggttgtcccaaattgtactctcaaggtagttcagtctcttgctggttcacactcagcctgagcccctgagggaaaacagtgcctggggcaacatgaaagcccaagaggtgcttctgagttgcccaggagttgctgagggggagcaggaaggattgggatttgctataacatagacctgtctagatgcggccaagagtcacacttacacaaatgggtgtcatttgtgtaaggtgaaagtacccatcacaacatctagtcttcattttcccatttggtctcctgggacaaatgagtgctatgcttattttatattactggacctagataacctgtgctgtcttgaaattcttctttttgatgtgttgaggatggggaagtttccatactgctacttcctttcctgttaactgcttgtaagatgat

SEQ ID NO: 293546 - DNA, 576 bp, Homo sapiens
ttgattcattgtgaactaacaaatgtatttttgttttgcagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaag

SEQ ID NO: 293547 - DNA, 6337 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaagattatttctctggatgaagagagaactgtggtcttgcaaacagatcctttacctcctgctaggtttggagtcagtaaagagaagacgacttcaaccggcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgtcccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctcgtggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcttaggtggaaaacgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaagggtaaccggaaaacttcttgctccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtaaaacag

SEQ ID NO: 293548 - DNA, 842 bp, Homo sapiens
ttgctgaaagatggtattatgtgaaatttgctaacaaagtcttcctcttttggcttctcttcacagtaaccggaaaacttcttggtaagagagagaacacattaattactatattatctgcctttgaaatatgagtcagaatagttatggcactttcccttttctgcagtaactcttttctgtttgtttcatttttaattacagtccaataaaaataaatcagtttgaagggcatttcatgaagctacaggctgactccaactaccttctatccaaggaatacgaggtacaactcaggcagaatgaagcttcagcatccctagttcttagcagaatttccttcctaatgtttactgtgtcatcataggctgattgagctcagaagttaggaggctgcttagaatctcagctgagcactcttttatgcctaaactatgccctgaatagaatataccatctaatcttagaggccagcttgagctccagaataacacagcaaaccaagggctacctggatcagatagtaaggaagaattaacaaatctcaaatgcagacctaatgctgtcagatattcagcctggccatttgcttggctggaagatgccgtggtttcgcaaaaagcacgtagcttttggaactgattctcaggtttgccacttgggtgacctggggcacatcagttatcctgactgagcctcacctgtaaaatagtgagaccaccacctcccttgtggggctgttgtggggatcagggctaatgcatgttgagtactaggcattcataaacaatagctagtgtatatattttcatgttattatgttatctccaggactgtatgat

SEQ ID NO: 293549 - DNA, 1385 bp, Homo sapiens
ggctgtgttgccttatgatctgcagacagaaagtgagccatggtcgagaaagaccctctgcccgtctgagcattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtaaaacag

SEQ ID NO: 293550 - DNA, 3462 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaagattatttctctggatgaagagagaactgtggtcttgcaaacagatcctttacctcctgctaggtttggagtcagtaaagagaagacgacttcaaccggcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgtcccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctcgtggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacaggtaatgtgaaatactgttcttgaacctgaatagatgcagtggtgcatttaactttcgggtagttcaggtatttcgattgagcatttggagggataaaagggagacagcaagaagggacaaagtcatgttgatagtgacaatgatgttgtccaacttttcatgtgagttctctcagtgggtgccaaaacatcagaagcattcaaaactttgtttgaaaatttcaacagttcattctctaagtgatgacttttaaatttattttctgttttagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacaggtaagcatccacctggagaagggctagattgtagaatgcctcatggttctccaaaatgggacagtgaacgggctcagctattcacaaatccagatttaaaaccaccaaagtttgtacaattcaatggtttcaagagccttactcatttattctttgtatttttctcttaatagagatctgc

SEQ ID NO: 293551 - DNA, 1295 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaagattatttctctggatgaagagagaactgtggtcttgcaaacagatcctttacctcctgctaggtttggagtcagtaaagagaagacgacttcaaccggcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgtcccctggctacctctacaacctcactgttatgactgaggctgcagggctgcaaaactacaggtggaaactagtcaggacaggtaagttccccctagctagctgaagaagaataaagtgaaatcaagggaatgtttaataagtcaagtttattatatgaataactgtaatataggacaaattgaaattcttataaggtatagaagacccatatccacttttctactcagaaaaagaaggattctcttttattctaaagtttaggctagcccttggcaacattttgaagtaggcaaagttaattactgatatggacctagcttctcttcttctctttttaatactctatctccttgctaaggattcctacttccttttcttaaacaggcaactgctgtctttatgacatcactcacagtgaaccagagttactttctccatgctatacataccctactcctgtgtgacagtcatttccaaaatttt

SEQ ID NO: 293552 - DNA, 343 bp, Homo sapiens
cctgagtaaaagtctcctttctgttctttcctgattagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatgtgagtcttgggctccagaatgttccttggttgctcaaatc

SEQ ID NO: 293553 - DNA, 468 bp, Homo sapiens
tcttgtttaattatgcatgaagtagtgctagtggtttatttggggaagggagatgttgccagttccttgaatgtgattcataaattattatgtaggtaaactctgatcagttcctttcctgaaatgtcttctcatttttctccctagttccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacaggtaatgtgaaatactgttcttgaacctgaatagatgcagtggtgcatttaactttcg

SEQ ID NO: 293554 - DNA, 801 bp, Homo sapiens
cataaatggaaaaatttgttcaagccaagtatcataatcagaataaaagttatctcccttatgtttcagccatggtcgagaaagaccctctgcccgtctgagcattcgtagggatcgaccattatctgtccacttaaacctgggccagaaagggtaaccggaaaacttcttgccttcgtataatttgctgaaagatggtattatgtgaaatttgctaacaaagtcttcctcttttggcttctcttcacagtaaccggaaaacttcttggtaagagagagaacacattaattactatattatctgcctttgaaatatgagtcagaatagttatggcactttcccttttctgcagtaactcttttctgtttgtttcatttttaattacagtccaataaaaataaatcagtttgaagggcatttcatgaagctacaggctgactccaactaccttctatccaaggaatacgaggtacaactcaggcagaatgaagcttcagcatccctagttcttagcagaatttccttcctaatgtttactgtgtcatcataggctgattgagctcagaagttaggaggctgcttagaatctcagctgagcactcttttatgcctaaactatgccctgaatagaatataccatctaatcttagaggccagcttgagctccagaataacacagcaaaccaagggctacctggatcagatagtaaggaagaattaacaaatctcaaatgcagacctaatgctgtcagatattcagcctggccatttgcttggctggaagatgccgtggtttcgca

SEQ ID NO: 293555 - DNA, 437 bp, Homo sapiens
ccagagaccattagtgaagcgatgttcaagaaatttgctaactatataatcccatcattgtcaacagtttgtgagtttctcatctttcttatgcatgagaacaggccctcctctgacatgtttctgcttttccacagtgtcagtatgtctacctacatcagtgtgtaagagatgtcctcagagcaagaaagctacggagtgaacaagaaaaccccttgtttccaatctatgaaaatgtgaatccagagtatcacagaggtgggcacttacttcacttacttccccaagtttcttcatcaagatatggtcaatctggccaggcatagaggcttacacctgtaatcccagcactttgggaggctgaggcaggaggatcacttgagcctaagagtttgaaaccagcctgggcaacatagggagatcctatctctacaaaa

SEQ ID NO: 293556 - DNA, 366 bp, Homo sapiens
gggaaaagcagcaggcactgttaaatgaaagcggtgttggccacgtcccctcccagtttagtctaggatactgaacccagagatggacagtatttctctcaaggtcacacagccaggcaggagtggagaggagcccaagtccagggcccagagtccctctgtaccccagtgggtagggtggggaaggctggggcctgctggggcctggagccctggcctcaccatggtaaatctcctgcagggagccccctccgcagaactccatgcagatccacagcggtcattcctagggacaaagagctggggtgggcacaaagcaggtcacatgggggctgcctggggccaggaggataaggcagcctcacc

SEQ ID NO: 293557 - DNA, 548 bp, Homo sapiens
taccctaataccctcattcttcatctcacatctcagtggcttctactattgctaactgcctccatcttaaaactcttggatatcatgacaccatattattctatttttcctcctttctctcttttcctccactgtatttttactacagtctgtccctaagccctccctatatactacattccacagagttcaaatcctgtttcaagtatcacctttatgctaacaaataactttctaataagatacatatataaagtttctagaagggaaggcaaatggttacaaatctgccttactttctttccattccaattgctacaagattcattgttcacactagattattccaagaattttttttttctttttgagtcagggcctcactctgttgctcaggatagagtgcagttgtgtaatcatagctcactgcagcctcaaattcctgggctcaagcgatcttcccacctcaacctcccaagtagctgggactacaggcatgcaccaccacgcccagcttgcttatcccaagaatcttattttatcttccc

SEQ ID NO: 293558 - DNA, 437 bp, Homo sapiens
accatttaacttgttttaatgtttcttcacaaatggtgaaaaatactaaagtacagacaaggaataatcataatgttgtggccaacattataaatatggaattataaatttaaaacattttctggtttaaaaaataaatctggtagtcaatgcagctctgcggggtctctgcatctagtagggccgatctctgcgctcctgacggtgctcgcctctgcaaggtaaagagggcccttcggttagaatgggaaggggtgaggaagcccttccagagcccccaggtgccccttcctggctcctcccaaccactatcacaagcttcctagagacatgaggacttgcgccaaccaagctgggaagggctgtcctcttactgtgcctggcggcccacagctgcttttcaccagcacttacttatccatttttccaggtcctcc

SEQ ID NO: 293559 - DNA, 962 bp, Homo sapiens
aattcggcacagggttgtcattgtccctccgctgtcaccttttcaagccccaggctggctgcttcagaagcccctgaccccatggaggagtgggacgtgccacagatgaagaaagaggtggagagccttaagtaccagctggccttccagcgggagatggcgtccaagaccatccccgagctgctgaagtggatcgaggacgggatccccaaggaccccttcctgaaccccgacctgatgaagaacaacccatgggtggaaaagggcaaatgcaccatcctgtgagccccgcacccggcccctctcacaccatcctgtgagaccacgcccggccccactcccaccatcttgtaagactgtgcccagccccactcactccatcctgtgagtcccactcccagccccactcccaccatcctgtgagcccatgcccggccccactcacaccaacctgtgagccccactcccggccccactcactccatcttgtaagactatgcccagccccattcactccatcctgtgagtcccactcccagccccactcccaccatcctgtgagccccacttccagccccactcccaccatcctgtgagccccactcccagccccactcccaccatcctgtgagccccactcccggccccactcactccatcctgtgagccccactcccagccccactcacaccaacctgtgagccccactcccggccccactcacaacatcttgtaagactgtgcccggccccattcactccatcctgtgagaccacgcccggccccactcactctatcctgtgagaccacgcctggccccactcccaccatcctgtgagccccactcctggccccactcacaccatcctatgagcccacgcccggccccactcccaccatcctgtgaaccccactccactcgcacgtgattacagtctgtaaaggtgtgactttataaagac

SEQ ID NO: 293560 - DNA, 447 bp, Homo sapiens
tctggggtgcggttctttacacacccgtctccttccttcaaccagtggaaggcagcgaactggcccgctcagcacaccgcggcccagggccacggcaggcgctcacaatcgagcacacgcgtgtgcacacacatgtgcacagatcagtgtcagaagcatcgacctgcgagctcacagagctgggagcagagcacccacgcacaccccgaatggctatggaagctgcagggcgccagggacactgggagtccctgctctcatggcaaagcagggacgggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactggagtttgaaaaaaa

SEQ ID NO: 293561 - DNA, 428 bp, Homo sapiens
tgaggagacaggacccggcccagcagtggaaggcagcgaactggcccgctcagcacaccgcggcccagggccacggcaggcgctcacaatcgagcacacgcgtgtgcacacacatgtgcacagatcagtgtcagaagcatcgacctgcgagctcacagagctgggagcagagcacccacgcacaccccgaatggctatggaagctgcagggcgccagggacactgggagtccctgctctcatggcaaagcagggacgggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactggagtttgaaaaaaa

SEQ ID NO: 293562 - DNA, 313 bp, Homo sapiens
tgagggggcgagtcatccacagtagactctggcctcccaggaaacctgggagcagagcacccacgcacaccccgaatggctatggaagctgcagggcgccagggacactgggagtccctgctctcatggcaaagcagggacgggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactggagtttgaaaaaaa

SEQ ID NO: 293563 - DNA, 317 bp, Homo sapiens
ggcatataatgccttggaaacgtgagtagtatagaatttgggaatttgggggctttagtaaaataattgcatgtgtgacatttcgtaaaagaaatgtggctgggcacagtggctcatgcctgtaataccagcacttcgggagaccagggcaggttgcttgagcccaggagtttgagaccagcctagacaatatggtgagaccctgtctctacaaaaaaattttaaaaattagctgggtgtggtggtgcatgcctgtgatcccagctacacaggaggctgaggtgggatgatcacttgagcctaggaggttgagactg

SEQ ID NO: 293564 - DNA, 942 bp, Homo sapiens
ggtccctttcacctcccacagtacgtgtgtcagctgcagttcgtcaagataaatgagcaggagacaacttcgtgtaaaaagtgtgtgaacctaggacaggacttttcgacccttatgaagaaagaaaggaaagaatattgcagctagatgtgttgggtccggactgaggtcagagttgcacagctttggacagatagcctggacacaggaaaccatgttctctcaattttaaacaaaaatgcaattatgtattccctcccctatccccccaccaccccccatacacacattaaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccccagctgtcggcagcatccagcccctccagtcacagtcctcacagagcttcaggaaaggacccctttgcagagctctctttggaggatttcttataaatcactttaggtattgctacttgttgtgggagatggggacttaaatacttaaaaacaattaccaaacattaaacacaattcacgcttctctttcatttctttaaaggactctaggctccctctcctcctcctcctcttcctctattctttaggtgcagaatgaaaagataggacataaggaaaaacaacttttggaaaatatctgtaacataattatttaaagtaatctcatccactgctcacagtaaatggatgagatcg

SEQ ID NO: 293565 - DNA, 867 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgtgagttatgcttttgtaatttaagattttaaaaaat

SEQ ID NO: 293566 - DNA, 672 bp, Homo sapiens
ggaacttttttcaaagttccagagagctattttttaacctatattgctttagatataagtgagtcttcagaaaattttgctgggctagcaggagaattacatttgttttttttctcttttataatacttctctcttatcccctttaaccctaatgtaattttgtcatgagataagagatgatttctgtcaaagcaaatacagccttctcagtcaattcagtatgaagtggtgactttcttcattttccatttaaagacatttactaatgtctattttttggataacttttccagtgaataaacaaggagaaaaggcaaagacctcctttagaaaaccatagcgtcataaagttccttacaaattctatttcgtctgtttgtaactttaaggcgctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaaaaagaaaaaactggggggaaaaagaccaggtctacagtgatagagcaaagcatcaaagaatctttaagggaggtttaaaaaaaaaaa

SEQ ID NO: 293567 - DNA, 361 bp, Homo sapiens
agagatgaggccaaagactacaattcccttgtcaaccttgatagtgttttagtatagatgttctttcattagatactggaaatacaagggattttaggtagttagtgaatgtacatgtgaactaaaatgctctctgtgtattttctgttgtgtaagtacttgttctaatccagtgttattgcattatgtaattgttctccctgggaaaaacagaatggcatgcattttccacaatacgtaagtgaccaaaaacgagcctttttgcaataaattggcatgctattaaccactgctgtagcagaatctcataacctttcagctattacttgttttcacattcagattttcaatgtgccagaaa

SEQ ID NO: 293568 - DNA, 3481 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293569 - DNA, 3207 bp, Homo sapiens
tgggcggacgcgtgggcgacccacgcgtccgcggacgcgtggtgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293570 - DNA, 3405 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293571 - DNA, 3127 bp, Homo sapiens
cacctctgacgagttcccatcctatgtcaactgcttctcaggtagcaagtacatggggagacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293572 - DNA, 3631 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293573 - DNA, 3607 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293574 - DNA, 3291 bp, Homo sapiens
gttaaatgtggtagagaatatccagtatcagtgcaggtttctttccagtgagacagctggagccatagttcaaaatgttttcgttggctgggcaccgtggctcagacctgtaatcccaaagtgctgggattacagacatgagccaccatatctggcctttatcagattttctgctgacatcattctgagaccagcccctgagaggtcacaaaaggaagggagactgattagaaaatgaaacacagccacgggacagtttgctggaaattgcctagggcctgagcatcatgaaggtatattggaattggtttgagaagacagttatatcctgattagatatcacttgacatttatgtaaacctggcctacctgacagagcatgagtttttaaagtgttatctgtggtgatttccagggaaagcatgttttatggagaaagacaaagtcgatgtcttcaggtttgtttcttaaatttttttttttttttgcatcaaagagcttgttcatggtcaggctttctcattcttaccatagtgtttttatcatattacacatagaagagaggggagttttcagattgtgacaaggtagcttacatacaggtgttcagaagacagggatggtaacttagatttgttgactttccaactctagtttccctactgttaacaacttttagggccaccaaataatatctaagccattggaaatgttgagtatttttggagattaaatattttcctgattcttaagaagtctgtttaaaatattactggtactagccgtgatgtcatttttccaaattttatttataaaatatttttattataatttattaaatacaatgcttttcttacagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293575 - DNA, 2747 bp, Homo sapiens
gttgctcatcaggtgcttattaagtaccttctgcatgctcagtagtatgtcgagcttttaggagtatggttttactttaaaatttaagtacttgcaagatttttaaaaaatgtttcatgtttacatagttttcagttcttaacgtttttgataatgtttcttaatatctccaactaggtcacgtttgtataacaaaagtaagattgtcattcttattaagtagctaaaactccactgttaattagtacatgaagaacatacctgtttatttttgttgctctctaattagatgatacttgatttaatttgaccagtggcctaattatcatgaaattcttaatatttgtacaattgcaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293576 - DNA, 3547 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293577 - DNA, 2823 bp, Homo sapiens
taataattatctgactctagaataactttagataaaggatttgatataatacatatttatatcattctagtaggcaaacaacacttttgttgttcctttagcaattcatttaaagactaaagctcttagatagacattcaaaggtgttcgcagtctattaagtggacattctttcatctctgttcttaattatctaaaattctttcccccatccttagatttttttcttcatctttattttttattttgaatctatgcaggaattatctgcacatgccaaaaacagcttcttagccctaatttgtcattaccctctttttttctttgaaagtttactcacaacacacataccaattgtcaatatcaattattcaagtaaacacagctataccaccacgaccagcacactcacctaggacagggaagattggtgcaggatgggtggctctttatagaaacatcttggttattattccattttttaactacctgactgttggctttgtggtgttaacaaataaaaggattttttctaaggattcacttaaaaatatgttaaatgcaattcttctatcttgatgattaggtattttttgtttttgataatttagatatttaagattaataaacaataatatagttactacttttcactttgcatcttttgactaattacaatactaatttatttacttcctttcttcattttgctataatacatttggactgcacagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293578 - DNA, 2059 bp, Homo sapiens
tgggcggacgcgtgggcgacccacgcgtccgcggacgcgtggcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293579 - DNA, 2223 bp, Homo sapiens
ggaacttttttcaaagttccagagagctattttttaacctatattgctttagatataagtgagtcttcagaaaattttgctgggctagcaggagaattacatttgttttttttctcttttataatacttctctcttatcccctttaaccctaatgtaattttgtcatgagataagagatgatttctgtcaaagcaaatacagccttctcagtcaattcagtatgaagtggtgactttcttcattttccatttaaagacatttactaatgtctattttttggataacttttccagtgaataaacaaggagaaaaggcaaagacctcctttagaaaaccatagcgtcataaagttccttacaaattctatttcgtctgtttgtaactttaaggcgctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293580 - DNA, 3442 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293581 - DNA, 1681 bp, Homo sapiens
ccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293582 - DNA, 1864 bp, Homo sapiens
agaactatttagaactatttaagatacttttttaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatactttcttgttcatttttcctttcactatgttaggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293583 - DNA, 1621 bp, Homo sapiens
ccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293584 - DNA, 1590 bp, Homo sapiens
tccactaagagtatcaggatcagtgacacatgagttacttctgtcatttcttactatgtaggcaccctgtatgctatctgtatacacacagcatgatagatatggacctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293585 - DNA, 1516 bp, Homo sapiens
ccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293586 - DNA, 2070 bp, Homo sapiens
ggtccctttcacctcccacagtacgtgtgtcagctgcagttcgtcaagataaatgagcaggagacaacttcgtgtaaaaagtgtgtgaacctaggacaggacttttcgacccttatgaagaaagaaaggaaagaatattgcagctagatgtgttgggtccggactgaggtcagagttgcacagctttggacagatagcctggacacaggaaaccatgttctctcaattttaaacaaaaatgcaattatgtattccctcccctatccccccaccaccccccatacacacattaaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccccagctgtcggcagcatccagcccctccagtcacagtcctcacagagcttcaggaaaggacccctttgcagagctctctttggaggatttcttataaatcactttagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293587 - DNA, 4522 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtctcttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgttt

SEQ ID NO: 293588 - DNA, 3424 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293589 - DNA, 3583 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaagttttgttatggtattctggtctgagatgcattttcatttttcctttctctttttattatcaatattgtcatttttccctaataaaatatacccaggtgatta

SEQ ID NO: 293590 - DNA, 4468 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtctcttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgttt

SEQ ID NO: 293591 - DNA, 3784 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaagaaaaaaaaaccaaaaaaaagggggggggcgcccaaagtttccccccgcggaggggccccggagttgttacggccttccccgcgctttgtcttggtcacagaggggggcccccctatgaggagagacgcggattatttaatagacgctgaggcccgtgggccggcgcgtctttcacccaggggtcgtctgcgctgcggacacaaccgtgctggtagcttcgggggacatctttgggggagaggggacacccctatcctcttcgtggggggcgtcggcacctcatgtgggcgaccaccctacctg

SEQ ID NO: 293592 - DNA, 3532 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaaggtgaaacgaagaattaaactgcactgttgatcgggtgctttgtgtaaatac

SEQ ID NO: 293593 - DNA, 3220 bp, Homo sapiens
  misc_feature (3148)..(3148): n is a, c, g, or t
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaggaaggggctntcctttcccttctttatttgtctccttttatttctcaatgattgccacttacaaaaggccctaatttttgtt

SEQ ID NO: 293594 - DNA, 2706 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttattatcaattttacataaccttattttgtgtcaaacttcttttgtgagttgggtgtgccggatgttgatttttccacagatgattggttcgggt

SEQ ID NO: 293595 - DNA, 839 bp, Homo sapiens
tgggcggacgcgtgggcgacccacgcgtccgcggacgcgtggtgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggtaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaag

SEQ ID NO: 293596 - DNA, 1429 bp, Homo sapiens
cattcatgagagggagccttaagaaggacagttcattgtaggaaagctattctgtacatgagtttaagcattcttgttgcattgtctctgcagattctatttttgtttacaatattaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtctcttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgttt

SEQ ID NO: 293597 - DNA, 2711 bp, Homo sapiens
  misc_feature (2471)..(2471): n is a, c, g, or t
  misc_feature (2476)..(2477): n is a, c, g, or t
  misc_feature (2482)..(2483): n is a, c, g, or t
  misc_feature (2487)..(2487): n is a, c, g, or t
  misc_feature (2491)..(2492): n is a, c, g, or t
  misc_feature (2630)..(2630): n is a, c, g, or t
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgtatgttagcaaaatgggtggattttcaaataaaatgcagcttccacaaaaagaaaaaacagcatcgtcgggaccagactcgtctcaggccagttgcagccttctnagccnnacgcnnaccnatgnnaactcactaccatgagaattgcagtgatttgcttttgcctcctaggcatcacctgtgccataccagttaaacaggctgattctggaagttctgagggcagaatctgtgtcctctgaagaaaccaatgactttaaacangagacccttccaagtaagtccaacggccatgaccacatggatgatatggatgatggatgatgactaccatgtggacagcct

SEQ ID NO: 293598 - DNA, 2216 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatctgcgtgggtgcgagctcgatggtct

SEQ ID NO: 293599 - DNA, 2651 bp, Homo sapiens
  misc_feature (2411)..(2411): n is a, c, g, or t
  misc_feature (2416)..(2417): n is a, c, g, or t
  misc_feature (2422)..(2423): n is a, c, g, or t
  misc_feature (2427)..(2427): n is a, c, g, or t
  misc_feature (2431)..(2432): n is a, c, g, or t
  misc_feature (2570)..(2570): n is a, c, g, or t
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgtatgttagcaaaatgggtggattttcaaataaaatgcagcttccacaaaaagaaaaaacagcatcgtcgggaccagactcgtctcaggccagttgcagccttctnagccnnacgcnnaccnatgnnaactcactaccatgagaattgcagtgatttgcttttgcctcctaggcatcacctgtgccataccagttaaacaggctgattctggaagttctgagggcagaatctgtgtcctctgaagaaaccaatgactttaaacangagacccttccaagtaagtccaacggccatgaccacatggatgatatggatgatggatgatgactaccatgtggacagcct

SEQ ID NO: 293600 - DNA, 2150 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgcggcaacaatgaatggcatgctttttccacaatacgcaccccctgtatggctattctgcttataaaacaacaggctgatcggattggaattccccaaa

SEQ ID NO: 293601 - DNA, 1479 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggtaagtttattgttaaaataccaatccactatctgttgtgtacaagttgtgaagagtattaagataagtaacatatagcccccattgtcaaagggatcaatgcagtttttgaccagttttaacattttgatgtattcctgaagattgttctaacactatgaccacgtaaaatgatctgcttaccacttatatttgttgcctacccactgtcataccatttatttaatctcttcaatcactctttctttcccatcatcattgtttaaaaaaggaaaaaaaaactttttggaacctgaatttagaaaatgatatttagaaaaacaattttcactataatgctggtagagaattatccagtatttatttttcctgttttaaacttccactt

SEQ ID NO: 293602 - DNA, 1289 bp, Homo sapiens
gttaaatgtggtagagaatatccagtatcagtgcaggtttctttccagtgagacagctggagccatagttcaaaatgttttcgttggctgggcaccgtggctcagacctgtaatcccaaagtgctgggattacagacatgagccaccatatctggcctttatcagattttctgctgacatcattctgagaccagcccctgagaggtcacaaaaggaagggagactgattagaaaatgaaacacagccacgggacagtttgctggaaattgcctagggcctgagcatcatgaaggtatattggaattggtttgagaagacagttatatcctgattagatatcacttgacatttatgtaaacctggcctacctgacagagcatgagtttttaaagtgttatctgtggtgatttccagggaaagcatgttttatggagaaagacaaagtcgatgtcttcaggtttgtttcttaaatttttttttttttttgcatcaaagagcttgttcatggtcaggctttctcattcttaccatagtgtttttatcatattacacatagaagagaggggagttttcagattgtgacaaggtagcttacatacaggtgttcagaagacagggatggtaacttagatttgttgactttccaactctagtttccctactgttaacaacttttagggccaccaaataatatctaagccattggaaatgttgagtatttttggagattaaatattttcctgattcttaagaagtctgtttaaaatattactggtactagccgtgatgtcatttttccaaattttatttataaaatatttttattataatttattaaatacaatgcttttcttacagcaagttggaattgacagaggtgatataccagacctttcacaggtaagtttattgttaaaataccaatccactatctgttgtgtacaagttgtgaagagtattaagataagtaacatatagcccccattgtcaaagggatcaatgcagtttttgaccagttttaacattttgatgtattcctgaagattgttctaacactatgaccacgtaaaatgatctgcttaccacttatatttgttgcctacccactgtcataccatttatttaatctcttcaatcactctttctttcccatcatcattgtttaaaaaaggaaaaaaaaactttttggaacctgaatttagaaaatgatatttagaaaaacaattttcactataatgctggtagagaattatccagtatttatttttcctgttttaaacttccactt

SEQ ID NO: 293603 - DNA, 1308 bp, Homo sapiens
tgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagaggtaaactgtctttaagtgactgtctcctaacttgcctttttgtctgtaagtatggattttgaagtcatcactcactatccaaataaaataaatgtcttcaatttagtattcaatcattattatgctgtattgaattctgtggcaagatatgaatatgataaagtagtgaataaaatacatgctgtaaatttaattcaatagcgagtattgaaaagttacctgtttttacattgtttacttctctataaaattaagtagg

SEQ ID NO: 293604 - DNA, 275 bp, Homo sapiens
tccaagcttaaatcctttcctcacaaaaagtagtggtgatgttcacctttccatttcttcagatgtatctacttttactactaggacacctactcatgaaatgtttgttggtaaagtaccatttaacctttttttccaatcaatgtttatactgcctaactatattttacgtgtccattaattattttaaaagcactgcaatagttactttagattttaatatcaaattctaaaactaaccagccataatgtagtgaggtttttaaattgacact

SEQ ID NO: 293605 - DNA, 496 bp, Homo sapiens
gcctcccggattcacgccgttcttctgcctcagcctctcaagtagctggactacaggcacccaccaccatgcctggctaatttttttgtatttttagtagagacggggtttcgccgtgttagccaggttggtctcaatctcctgacctcaagtgatttgtccaccttggcctcccaaagtgctgggattacaggcatgagccaccacgcccagcctcaagtctctatcttactctgttctatataagtatatagctaaggaaactttataattagagacatttaatattctcacttatgtttatttaaagtgatgtaaattggagtcaaccaggtgaaaagaagttaactgggggatctaactggcaaccaaaggttgcaccaacaaccgcttggaatgcggcaacaatggtgagttgaaaaagctcctgatagactaacagttgaataatttagttaaatatgtaacatgaaaatgtttttaaagtgatagacat

SEQ ID NO: 293606 - DNA, 312 bp, Homo sapiens
ccctgtccccccccccctccccttttcccccccgttgccgtttcgcgccccgccccccccccccccccccccccccggtaaaaaaaaaaaaaaaaaaaaaacaaaaaaaaaaaaaaaaaaaaaaaagatagtctccaaaacacaagaggtaaggtttaagtcccattggcttacgacaggaagatatgtgcacatctgcagagctggtaacagggaggcaggcattccctctgatggttgctgtttcttaatgaggcatgtgttgtggtaactaccacaagggggaattgatagataagacagaagttttga

SEQ ID NO: 293607 - DNA, 496 bp, Homo sapiens
tgaagaaattagtcacagatgtttattgaattcactgaacaaaatgagcctctctcccacaccctcaaggtagttacaattgtatccagaatgtgtcccgatggcacaaccataaaaaccatatagctggaactctcacgcgagtgcatattcaaatgtccctttatcaaactcttcaacttcatcttcccatgtagaggaaggcatgctactatatgggtctagcaggattttgaagcatcggataataagaagtcccaagaagatacacaaaatcccaacaaaagcaaagccagttttttgctccagagtcaatgagaaagctgatacttcgttgacactcatcttagctgaagagttgccacagtaggtactactcattattcactggcacattgttgtggctcttcacagttccttctggaatcaactctttgcctagatgtcttcatcatggtgaaatgcataaatttcagggctttccagagatcccaga

SEQ ID NO: 293608 - DNA, 157 bp, Homo sapiens
ggaaggaatcatttagacttagcactaaaagcagtggaaaaatgtgacttgaaaagacatgtgagaccaggtgcagtggctcacgcctgtaatcccagcactttgggaggccaaggcgggtggatcatgaggtcaggagatcgagaccatcctggct

SEQ ID NO: 293609 - DNA, 143 bp, Homo sapiens
gcctgcaggagacatttccatcctgcttctgctacttgctgcctgtgtgaccttgggcaagggacttggcctccaagcctcagtgaccgcccctgtgaagcagggctgccggtgcctgcctcctggtgctctcagaggacatg

SEQ ID NO: 293610 - DNA, 1789 bp, Homo sapiens
cgaaccgcccggcggggcgggagcgagaaaggcggaaaagcccgggagagtcagcgcccgggagccgccggggaagcgccggcggaactgggcgcggagggcggtggcgcgtccccgcgcatcctgcggctcgagctcctccgaaggcgggggcgcggggcccctcccgcagtcctggggacgacaaaagtctcctggcactgggggcaagagaccagaaaaaggagtgatgggaattcgaggctctccccggccttggaaaaccctggaagcgctgcacctccctcctgccgcacggatttgagcgcggccccgacgtcctggcgtccgatcggcctgcggagtcccccgcgggcgcgcacttccagccgcgaccccgccccgcagccccgggtcagatccgccgagtatgaagcgctcggcttttcttttgtgtgaggagcacccacgacgccccgaccatgggcgcaggggcagaggcgaaggtcgtcgctccgtccgctaccccgtcccccagccgcaagcgccgaggagccggaagagaggcggaaagggcagcaggctccttacccagaccagcgaggggaggtcagctcgtcgcggggtgtggctcccgtccggggactcccgagctcattacgggtggccgtgtgtagccaagttcaagctctccctccgggaatgcctgccgcggcggcggaatacggcttcttcaggacattcagcaaagcggggaggcggggacctgcgggcggaggagcgacgccccagctgggaacgcggcggacgggcgagcggggggtgcgccctgggcgcgccaggccgcagaggctccggggaaagttctcttggccgcgcgagtggtggcgccccgggcgggagcagcccaggtgcatgtgggcccggtccaggcgtctgcaaaaagccctggaacgaagcggaccccccagtccagcgctggccgcggcaggggagccccttctgggcggggtatcagctgggggcggagggcggggcagagaccgtggtcccagcggcgaggtgccggcgagtccacgctgccaagccgcacactgcgcccaagccgcggggcagtccagcgctcgctgcgtccttcccccgagagacctggaggctgggtggggagaagaggacgcggtgctgctcggaccccacggttcggcggtcccaatcccacgccctccgcgcggtcggccgcgtccaggactgaggggcacaatagctctgaagctgcagtgacccctggtgggtcccgatgtccgtgcacaggcagccgaggttgagctgcggacgacactgagccccgctgggcttcggagcaggtgcaatctgtgctctccagctgggaaccagcagcgagttaatgcgagtcgcagttaggggagacacgaggggaggtgtcacagaaaaaaaactctatattgagttttagagttagagctttggcatcagacgtagttttgagttgactattctactgcttgttagctgggtagccaaagctcaaaaaaaattgcttaaaacctaggacgttagcccttaaaacaaaaccaggcttccgtagcacagtagaaatgaaatgaacaattggcgacttttgatggagtttcctctcatagtgatttgccacaaaggaccttctgtaggaagcctcggccttccctgctattgtgaccccatccaaacacaggatcagcataaccgccaaagtgcaatataaatttctgaactttacctaggctatgaataaaactattttatcttctga

SEQ ID NO: 293611 - DNA, 5509 bp, Homo sapiens
  misc_feature (3071)..(3071): n is a, c, g, or t
  misc_feature (4020)..(4020): n is a, c, g, or t
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactccnggccaccgaatcaaattagcctttagtgaatttgagattgagcagcatcaagaatgtgcttatgaccacttagaagtatttgatggagaaacagaaaagtcaccgattcttggacgactatgtggcaacaagataccagatccccttgtggctactggaaataaaatgtttgttcggtttgtttctgatgcatctgttcaaagaaaaggctttcaagccacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgnagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaaggttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgt

SEQ ID NO: 293612 - DNA, 604 bp, Homo sapiens
agacatcacttacccagagtcacagagccagcaggcactgggactgagattccaacccaggtcgtccatgtctggggcctgggtggacacccatgacactatctgactctccagttgtggaaaacatatctgacgctggaagtagaaacagaagttagacaatggctaggctacactgaaactacactgaaatttaaattggacccgttaaagctcattgaccttactcatcttatttttctttcctgggcagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccggggtaaatataccaccaacagaataccctagacatgattaaagatgcctattgattcatgattgatatgtgtaccattcacaagttggcaatgctttttgca

SEQ ID NO: 293613 - DNA, 7270 bp, Homo sapiens
  misc_feature (3071)..(3071): n is a, c, g, or t
  misc_feature (4020)..(4020): n is a, c, g, or t
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactccnggccaccgaatcaaattagcctttagtgaatttgagattgagcagcatcaagaatgtgcttatgaccacttagaagtatttgatggagaaacagaaaagtcaccgattcttggacgactatgtggcaacaagataccagatccccttgtggctactggaaataaaatgtttgttcggtttgtttctgatgcatctgttcaaagaaaaggctttcaagccacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgnagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaaggttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaatatcaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatgtagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttactaaattaattttttaaattattttccaccctacatcagtatattggttgtgctttatatttgccaaagtcctaactgactatacatagaaaaaaaaaaaaacactgttctcacttgattttattaaattatttttaaaagtcaattttgaaaataactgtattttattaaggagatcgtgacttaacttaaatggacaaaataactttttaaaagaaatggatgagaagtaattgtgtttccaaaaccctcaaatatcccattcctatactggctggatttttgctacctgtcgctcattttaatatgtcacagtatgagattcaaattctgtttaactttgttttaaaatagcttggtctcttttatttggtttgtaatactgctgtatttttggtggtaagcttcaaatatcaaattttgttctgccgtgtagaaaaatctctaaaagcatcaaatgactaattttatttttgcaaggttaaaatttatttttaaaagaaacattaaattatatctttatgtagatttagaaggactgcaaccctatgtgacattataacttacttaaaacagttatcaaatatttggaaactattgtttactaataagaataagacttgccttatggaaaatttttgataccacttgttaaatcaggcatgggaggaggagagcagaaaatataattgccttctaaagat

SEQ ID NO: 293614 - DNA, 4220 bp, Homo sapiens
  misc_feature (970)..(970): n is a, c, g, or t
agacatcacttacccagagtcacagagccagcaggcactgggactgagattccaacccaggtcgtccatgtctggggcctgggtggacacccatgacactatctgactctccagttgtggaaaacatatctgacgctggaagtagaaacagaagttagacaatggctaggctacactgaaactacactgaaatttaaattggacccgttaaagctcattgaccttactcatcttatttttctttcctgggcagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgnagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaaggttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaatatcaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatgtagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttactaaattaattttttaaattattttccaccctacatcagtatattggttgtgctttatatttgccaaagtcctaactgactatacatagaaaaaaaaaaaaacactgttctcacttgattttattaaattatttttaaaagtcaattttgaaaataactgtattttattaaggagatcgtgacttaacttaaatggacaaaataactttttaaaagaaatggatgagaagtaattgtgtttccaaaaccctcaaatatcccattcctatactggctggatttttgctacctgtcgctcattttaatatgtcacagtatgagattcaaattctgtttaactttgttttaaaatagcttggtctcttttatttggtttgtaatactgctgtatttttggtggtaagcttcaaatatcaaattttgttctgccgtgtagaaaaatctctaaaagcatcaaatgactaattttatttttgcaaggttaaaatttatttttaaaagaaacattaaattatatctttatgtagatttagaaggactgcaaccctatgtgacattataacttacttaaaacagttatcaaatatttggaaactattgtttactaataagaataagacttgccttatggaaaatttttgataccacttgttaaatcaggcatgggaggaggagagcagaaaatataattgccttctaaagat

SEQ ID NO: 293615 - DNA, 1836 bp, Homo sapiens
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaaggtagtttataccgtcaagcccactattttat

SEQ ID NO: 293616 - DNA, 2905 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293617 - DNA, 2838 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293618 - DNA, 886 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagagcactatttacaagagccaagatttggaagaaacctgtttccatcaacagatgaatagatgaagaaaatgtggcacatacactcaatggaccactattcagccatgaagaagaatgaggtcctgttttgcaatgacatggatggaactggaggtcattatgttaaatgaaataagccaggcactgaaagacaaaccacatattctcacttatttgtgggagctaaaaattaaactcatggagacagagagtggaatgatggttaccagatgctgggagggtagggggaagtgaggatggttaatcagtacaaaaatatacttaggtagaatgaatattatctagtatttgatagcacaataaagtggctgcagtcaacaataatttattgtacatttaagaataactaaaagaaggctgggcttggctcacgcctgtagtcccagcacttt

SEQ ID NO: 293619 - DNA, 382 bp, Homo sapiens
gcggccgactactactactaaattcgcggccgcgtcgacattttagattgacaatatttagctatttctgagcaactctgtgtgatttatacaggaaaaaagggataaacattataagttttctttaaggtctttgttctcaatgactaatattaaaataaactttttgtagtcttggacagtaaagcaccaaaaccagaagacattgatgaggaagatgatgatgttctccatgtctgtaaaactttggaaccacatagctgatttgttaaatctagtccatgccagcttccaaaaaccaaacttttagttagcttcattctttgatgcctcatcaaaattttctacaagatctggaacatcagtcgacgcggccgcgaat

SEQ ID NO: 293620 - DNA, 2721 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaaaaaaaaaaaaaaaaaaaaaaaaaaaaaaaaaaaaaaaagggggggggggccaaaaatcccccgggggggcccatggggccccccggttttttgtgtaaagaagggggcccccctatggggggggcattataatagcagcaggaggcagcagcggcggggttaacaccaacgtcgggacggggaaaaccaagggcgaccagcgggacaccttggggaggaaggaccccaacctcgtcggcgggcggggccacatagtcgcgaaccccacccccccaaagaggttataagcgcccgagggaaataaaccaccggtgttcatcgtgtggacaccagccctatttctggcgcggagaattggcc

SEQ ID NO: 293621 - DNA, 3137 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaaggttttcctcacaaattcttacctgttcttccatgttggtgaatatgaatatcagctttcttattccctgtactttttaaagcctaaggaagaactagttgtgagcaactgaagtctttgattctcttcagctgtggcaccaggctcaaggagaatattctacccatatctctgcccaacacaatctttgcaaaagtgaaagaaagaatagtacttacctcagacctgaagtgggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293622 - DNA, 2466 bp, Homo sapiens
gcggccgactactactactaaattcgcggccgcgtcgacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293623 - DNA, 2703 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293624 - DNA, 2416 bp, Homo sapiens
gttgctggggctgatctagaggatcccaggtcttttccctcaaagcagcagttagctgatgaagatgaaatatggaagcaagacgaagacaacaatcaggaaaatttctgcgagcagtagaacgtgctcgtaaacggggtgaagaggaagagcgaagaatggaaagaaacaaagggaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293625 - DNA, 1032 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggttagggatgcctgtcgggatcatctagatcgactc

SEQ ID NO: 293626 - DNA, 1708 bp, Homo sapiens
ggccattgagataaccccgagatccccgggaagaggtttctccgggatatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293627 - DNA, 1580 bp, Homo sapiens
cccctccccccccgccccccgaccccatacagtcaccgacttgcatgtcaccccactcccgacacacttaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293628 - DNA, 1795 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcagttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttt

SEQ ID NO: 293629 - DNA, 439 bp, Homo sapiens
cgaggatgaatctatggttatgaagtactttccatggtatccaacatgtccaccacgcccaggcaactctgtcataccaaaatttctaaagttcctgtgtcatactgcatggaactctcctgctctttcagccttaggtcaaatgcatggcaaaggaatccactacactccagagaaaggacatcatggggaccgaccaccatccaaagcaactgacagtcgttctatctctcgttctcttagctcaatctgaagatatagtcatgctgtcattttaaaaaatctggttttcaaccaaatgattaacactgtacaaacatttatttggatatattttcttatgtaccaatgtatgcaagagattaacattcatatttgtgtccatatattatatgcataaatgcagaacaaaaataaattacatagaaaatgtcaacag

SEQ ID NO: 293630 - DNA, 329 bp, Homo sapiens
gatacctcatattcataaaagtataagaacatgtggttctaaacatatacactctatatccaggataaggtactcattgggaccgaccaccatccaaagcaactgacagtcgttctatctctcgttctcttagctcaatctgaagatatagtcatgctgtcattttaaaaaatctggttttcaaccaaatgattaacactgtacaaacatttatttggatatattttcttatgtaccaatgtatgcaagagattaacattcatatttgtgtccatatattatatgcataaatgcagaacaaaaataaattacatagaaaatgtcaacag

SEQ ID NO: 293631 - DNA, 6938 bp, Homo sapiens
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctgcagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagcctcccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcc

SEQ ID NO: 293632 - DNA, 6146 bp, Homo sapiens
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctgcagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagcctcccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcc

SEQ ID NO: 293633 - DNA, 7331 bp, Homo sapiens
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctgcagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagcctcccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgccaaaaaaaaaaaaaaaaaaaaaaaaaacaaaaaaaaagaaacaacaaaaaaacaaagacgacaaaaaaaagagggggcgcgcaaaaagaaatacccagaggtgaccaaattagaaacaacagagattatgagacaaggggaccaaaagagagcgataagaccaaagcaaacggacacgcctaaacacacgcgcacaaagcaaaaacagagagagagagaagattttggtagaaagagacaactctactatggggagggcacaacattgtgagaaatctacccgacagatactaaacacactggatgagaataaagaaacagaagctcataaaggtaaaaacagaagagattgtaggtgtagaatatttcaggaaaattaaagaaaaaattaggg

SEQ ID NO: 293634 - DNA, 6439 bp, Homo sapiens
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctgcagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagcctcccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataaggga

SEQ ID NO: 293635 - DNA, 2224 bp, Homo sapiens
cttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggacaactgaaggagccgctctggttttaattgcagcaattaaaaccagagcggc

SEQ ID NO: 293636 - DNA, 372 bp, Homo sapiens
aaggggatccccagtgagccccaggaggcatcagaaaggtaagtgaaggcagaggggaacccaaggtgatacacaggcctcgtgataatcaacccctgggcaaccagctgcttggaactcagccacctttgtgtttactttctgtctaggcctcctgaattgcaagatgccacctgctgagaaggcttccaggatcagagctgctgagaaggtttccagggtgagagctactttttctacctcctattccacaagtcatctctatatcttctccaatgctctttcacctagcctcactttaatctattcctttctcattattcagttttcttccatttttgtcacgccttgattggcttctattcctttatc

SEQ ID NO: 293637 - DNA, 508 bp, Homo sapiens
taccaatgcccaggttccaccccagaccaataaaatcagggtatctacagagcaggtgtggaaatctgtatctgcaaaggttgagacacattggtttagggcaaaggaggagattaaaaatggctccagattctttgccattcttcccaccaaaaggaatctgctttgctctgtgttttgcattgaccaggagagaatgaaatggaaataatgttctgggacttttgagtacaggccttaaaaggactggcatcttctgcttttccatttggaacaccagcctgctgtattgtggaaaagtccaggccaggacactacatgattagaggtggtatggagagagcactggaggagaggagatcatcttggatgtcccagctttagccaaactcccagctgaatgcagctgcacatgtgacctcagcctaccccatctgaatcagacccacccagctgagctcactcaatccacatatttgtgagaaataataaattgtttgaagccact

SEQ ID NO: 293638 - DNA, 706 bp, Homo sapiens
tcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgccaccctgcgggaagtttgggcagcacggagtccgccagcattctacaggaagtttgggggagcacaaggttgcctgcagaaggccatcagaaggggagagtgatctgcctgctccccgcagttgagagtgctgcactgcaagtgttacctggagagaatgaaatggaaataatgttctgggacttttgagtacaggccttaaaaggactggcatcttctgcttttccatttggaacaccagcctgctgtattgtggaaaagtccaggccaggacactacatgattagaggtggtatggagagagcactggaggagaggagatcatcttggatgtcccagctttagccaaactcccagctgaatgcagctgcacatgtgacctcagcctaccccatctgaatcagacccacccagctgagctcactcaatccacatatttgtgagaaataataaattgtttgaagccact

SEQ ID NO: 293639 - DNA, 509 bp, Homo sapiens
ctttacagtctgcgatgattgacgaggtcaaacaggactcacttgcattgccgggtctctgtggcgacagggaggacttggagatcaaagaaactctagtaacgtggaaattcatgctccgagtagtgacaagccagtgactttttctatagaaagggtacaagactccaatttgaaaatctcaagcagctttatattcaagcaagttcaatccaatctcttcctgactcactgtctcatcaacatgcaaagctctcgaagagaaatcatctcttacttgcctgagggagttctggcagacgttttgaatgtggatgtggaagttctttcctcgtctccatcctgtcaagagccgtggagcaaacagcaggatgaggaagacatggaagacaaaactgataacgcacgtcacctcgctgcagcgggagacagaatgtaacttcaattcagcctctttggggtttgggttctgaccaagtaaatcgggaatgttgttaacatatcaaaaa

SEQ ID NO: 293640 - DNA, 871 bp, Homo sapiens
tatttcttacgtacgcaatgatggctgaagtccatgcggagtttatcactactggtcagtttcagagtgtaggtcagaacccgtgagccttccttgccagaacagtttggagtgtcacacgaggacttcagcctggacaccagaaccaggtgggcagtggggcccatcacgtgccactgtagtgtgaagggacagggtctgcctgctggtctgcccagggagaagatactcctagctcttcaggctcctactcaatcccctgacagcaccccttagcgaaaaggcaccaccctcggcgtcaagcgcatctctgaatgagggtcatggtgagcttgtgttaggaaaatagctctcttgccaatacgcaggcaaagtaagcttctgcaattctcaaagtcccgagtttgcagaattttatttacagcaaaatgttggtttacccacaaacatcctgcttggctaaatatatctcctgctcctagaacaggacctgtggttttcaagcatgggttttggcctcccttcagcatgctggcatgcatgtgccctgctctttctcctgtgatcatcggcatgataggaggcgagtgaggaactcagtgtcttctgacacaggcatctcacaacaccagtgcagccggaccgttgtctggtaggtctctgtgcacccaggaggacctgggcctgcgagaagtctggggcccactgctgggtatgctcgtttcttgagcatccgagtcacctttacagtctgcgatgattgacgaggtcaaacaggactcacttgcattgccgggtctctgtggcgacagggaggacttggaggtaggtgttcaggtcagaagggacagtcctgacttcctccaccgct

SEQ ID NO: 293641 - DNA, 450 bp, Homo sapiens
acgaggagcccagcgccaggccctcggcctcctgcttcagcggcaccgtcagctccatggggcctcctggacggcagcgcctgccccgcgtggcccagggtgcaaagaggtctctgtgaggggcggcgctcactcgggcggtgaggaaagggtgtctgtctcgtgggatcccacggagtcaagtgccggctctgcccctcgttgggccccttccgcggcttctgtacctcagtcctgcagctcctcccgcagcctgtcctacagcacaaaggctctggagcaaattccagctctgcctcccaccagctctgtgtccttggacaagagggaatgcagtatggcagcattttctttggaacaaattaagaagatagtaacaaataacagaagaaatacttctacacatatattttccatgggcaataaacagataagtatataattatgaaa

SEQ ID NO: 293642 - DNA, 5816 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293643 - DNA, 4437 bp, Homo sapiens
cctgggctctgtaaagaatagtgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293644 - DNA, 3244 bp, Homo sapiens
gtgagttgtattttagaagttcctgtcattccatgagcaaactttctgtgtttcactgcttgaaagtgaaaccagctgtcttgctgacagttgtggccttgccaagattacattcactttagtctcattgtgaaacttaatatatgcttagttatacaaatgtatttttcttttaacaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293645 - DNA, 5876 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaataaaaaaacctgaaaaaaaaataactccagggggggcccgtacccaaatttgccctatgtga

SEQ ID NO: 293646 - DNA, 5095 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293647 - DNA, 6155 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaataaaaaaaaaaaaaaaaaaaaaaaaaaaaaaaaaaaaaaaaaaaagaaaaaaaaaaaaaaacaaaaagaagaggagggggcgcgggcgcgccggataaaagataatctcccgcagcgaggggagcacgcaacaaaaagacgaccgaccaaacacacaatatatgtgagacaaagagggggggccgaccagagtgagggagcacttctaaaacaacagaaggagcgagggcgcgcgcgctaaaacaacaggggggaggggggaaaaacacggcgcagggggaaaacgtggggaaacaagaccagctatgggagggggaagcaaaactaggcgaaacaacgag

SEQ ID NO: 293648 - DNA, 1419 bp, Homo sapiens
ggatctcgtcaggagagagaactggagttgaagccccagggagcccccacttaggccaagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293649 - DNA, 867 bp, Homo sapiens
gaaacatttatcacataacttcttttttcatttaatttgttaaagttttattttagatgcagaggtacacgtacaggtttattacatgggcataccgtgtggtgctgaggtttgggcttctaattgtcttgttgcccaagtagtgaaaatatgtttttcaacccttgccccactccttcccccactacgtaacttcttatgtgataaaatgtgaataacataacttatttttgtttccttaattttgtaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293650 - DNA, 3963 bp, Homo sapiens
  misc_feature (3891)..(3892): n is a, c, g, or t
  misc_feature (3960)..(3963): n is a, c, g, or t
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcgggtgagtctcagagagctggtcacatagtccagacccacggggaggtcgtcttgttgccctgcaggggactttggcaagcttggaagttgacactagaatacagaagccttacagcatagagggatggggctccgggctcccagccagactgcctgagtctcagaacctgggttggccactcattagcttagccgtgaccttgagcaagttccttaacctctcatctgtaaaaccaaggtgataatgaaaatacctacctcctaggattgctgaggaataaatgagctcatacatagaaagcactcagaacagaactgaaccaaaagcaccaaatcagttagatgttattatttagcataagaatccaagcacctagcctcgctcttggcaggtactcagcgaatgaatgctgtatatgttgggnncaaagttccctacttcctgtgacttcagctctgttttacaataaaatcttgaaaatgccaaaaaaggnnnn

SEQ ID NO: 293651 - DNA, 3919 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcgggtgagtctcagagagctggtcacatagtccagacccacggggaggtcgtcttgttgccctgcaggggactttggcaagcttggaagttgacactagaatacagaagccttacagcatagagggatggggctccgggctcccagccagactgcctgagtctcagaacctgggttggccactcattagcttagccgtgaccttgagcaagttccttaacctctcatctgtaaaaccaaggtgataatgaaaatacctacctcctaggattgctgaggaataaatgagctcatacatagaaagcactcagaacagaactgaaccaaaagcaccaaatcagttagatgttattatttagcataagaatccaaatctccgcttgtcccgaaggcctgggtaaacctcctcactggctgtgctggactcgtgctgggggcatgtgacctccaggcaga

SEQ ID NO: 293652 - DNA, 960 bp, Homo sapiens
gttccggtccggaattccagggtcgactactactactaaattcccggccgcgtcgaccacagacttgactcgatatgcttattctaccaagttgttcctggtttacgtgacacaactgaatgtatgccagtttcatgggggactctcagatattctgaaggtacctaatcaagtcagtacagtgggaaggagagagaaacagaagcctcatttgtgaaatagtacttgagtttgtgcgtgaagaatggataggatttagactgagaagcgtggaaaggggacaaccataaacaactgtagagcggctggaacgtgagctgtgctccaggcatccctgatgcctgcagtcgacgtggaagccaggaggtggcgggcacagggcacttgacaatgcagtgcataagctcaaggtcagacgggcagaagaacttccgtaagatgccaaggaaaactgcttttattaaatatcttaatttttggcagaatcattttgtctgatataatgtgatgggtttagtaccacattacatttcacatgttatattctgaaatctgaaacttttttttttaatctaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaata

SEQ ID NO: 293653 - DNA, 3728 bp, Homo sapiens
gaaggcttaaagtaaatttattatctcactctcctgtttccacgaactttcccgaaattttcttctttcccggccttgtgaatcccttccatttctcagttaaaggacagcaccatccacccacctctctcaaagccgagctttgtattaatcctcattgacaaaatccctcctgaaatatgaaactgaaagccctgaaccctccggctgatcttggaagagaaaccccgccagaggccggggacccgctccccacctggcggacccgattccgggcgcgttccggctatcgtccctgcttgggacgctgcgcccgcctggtgcggggcggggttccggcgcagtggcgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggtatactcctttttacttagacataggagacactattgaaaaaatgtttcagaataagctggttaaacttgcaaattattgattgtcctgaaaaactagcattacaaaatgaactctcacatctcaagattctgcaactaaaaatatttatgatatcaagcatgccaaacttctgacgtttcatccaaaacccttatgtggatgatttgcctgtacaaattcgcatttttaccttaagctccaccaaaagaacatgtgccatcagacattacattgggtattctctataacttgttatagttttaaaatactgatactggaaaaacaaataagcagttatttgtggttggtaataagatcattttgtgtggctgtgacaaagagtctcttcttaagttaaaataaaaatagaaacttaggctgggtgtggtggctcacacctgtaatcccagcactttgagaggccaaggcagatggattgcttgagctcaggagtttgaaaccagcctgggaaacatagtgagacctcgtctctgtaaaaaattaagaaaaaaaattagccaggtgtggtcatgcacacctgtggtttcagcttctcaggaggctaagacagggcgatcacttgagtccaggaggttgaggttgaactgagctgtgatcgtgccactgcataccagcctggacaacagagggagaccctgtctcaaaaaaaa

SEQ ID NO: 293654 - DNA, 443 bp, Homo sapiens
gtgtggcttcgaagccttcatcaatgggaagcacatagttggagaggtaaggcaagaagatgcatcgtgcccgctctcggctttcaaagtcagcttccatttcccagaacctttgtttttggagtccccatggctacaaggttgagtagcagccttatcataaaacgagaatattctttgaagaatcagttcttgcgcagtgagcctccctcaagcatccctccgtgatgaagggtttctacccccatctgtccagtcttcatcttcagtgtcttgcacattctttgccttggcaccgtaagagtgatttcagtatgaaaagttaaagagggccgggtgcagtggctcatgcctgtaatcccagcacttcgggaggctgaggcaggtggatcacttgaggtcaggggttcgagctgaaatgaaagctattgtaactttctaaa

SEQ ID NO: 293655 - DNA, 221 bp, Homo sapiens
ccctcggaaagtgtatggacttacatgagaaggacttttccttaactgaagcaccaccaggctacgacagtgtgcatggagtttcacaaacagcctctgtcaccacagactttgaggtatttttatttcaaggaagaagcaaagagggtcttgaatgctcaaagaaaggccttagttttttgctcctattttcattaaatatgcttaagtttaaataattg

SEQ ID NO: 293656 - DNA, 392 bp, Homo sapiens
agtcttgtcccttcactctgcagggcattgggcggaaggtgatggagcggcagggctgggctgagggccagggcctgggctgcaggtgctcaggggtgcctgaggccctggatagtgatggccaacaccccagatgcaagcgtggattggggtaagtgtgactgagggacttccctgggggcccaagcctttcagctatgccctggtttccctcttcccactggttttggcatggctgctgggtactcgtgcgggatgaaattcaaaacagttaagaggaaaaagtggatctgggccaggcacggtggctcaagcctgtaatcccagctacttgggaggctgagacaggagaatcacttaaacccaggaggcagaggttgcagtgagccgag

SEQ ID NO: 293657 - DNA, 2145 bp, Homo sapiens
atccccccccccccccccccgatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggaaaaaaaaaa

SEQ ID NO: 293658 - DNA, 1825 bp, Homo sapiens
atccccccccccccccccccgatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggaaaaaaaaaa

SEQ ID NO: 293659 - DNA, 1903 bp, Homo sapiens
gcggggggaggcgcgtcgaggcagcgtcctccttttgtgcgagcgccggcggctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293660 - DNA, 1990 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293661 - DNA, 874 bp, Homo sapiens
tcagcactttgggacgagggctggtggatcacttgaggtcaggagttcaagaccagcctggccaacatgatgaaaccctgtctctactaaaaataaaaaatattagccaggcatgcttgcttgaacctgggaggcagaggttgcagtgagccgagatcgtgccactgcactccagcctaggcgacagagcaagactatgtcttaaaaacaaaccaaacaatcaaacaaacaaatgctatttggagttgttattcccaaactgtacctctactatgggaaaattgcttaatccttgctataactcttttacaggagaagaaactgaggcctggaatttgattaactcattcaaggttacccagttggtaagtaacagagctggaatttgaccatggtcatctggctccagagccagcactcttaaccacacttcctatgaggaaaaattaaagtggatggtgatggctacaagatggatttcagttgcatagaaataagaacctcctacctctgttgaaatcagaatacatatacaccccttcattcactctatgaatattcattcattccatgaacctacaaggtttttaggtcaaattattagtttaaataagaactataggctgggcgcagtggctcacacctgtaatcccaacactttgggaggctgaggtgggtggatcacttgaggtcaggagttcaagaccagcctggccaacatggtgaaatcccgtctctactaaaaatacaaaatttactaaaaatactaaaaatacaaaatactcacttgaacccaggaggcggaggttgcagtgagctgagattgcgccgctgcactccagcctgagtgacagagcaagactccgtctcaaaa

SEQ ID NO: 293662 - DNA, 843 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagattaccacctggaggagacgcggtcatctgctgaggtaaggggggtgtctaaactcttgtacccgtgatccggggcgccttggcaacctccaaatgcgattaa

SEQ ID NO: 293663 - DNA, 612 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtgagtgattggtttttgccattttcccctcttccttcacactcctagctttcctgctctgcgaccccattttggcgaagaggcgggtgcggcggggcccgcgctggcgcggggcttcctcctttccaggcgcgctgggcccgcccccggccccgcgacgccccgggcccgcttcctctgtggccccgcggccccggcctgcccccggcgctcattcattcgggtcttcctttcttccgcccccttccttccattggcacctccacgcgcgctctcgccgccccctcccaccccagatcctgcgcccgccagtgactcctggctcgttggctcgtcccttcccgtgtcggcgttgtcccccctccccaatcctggctcccaccactccttcctcttcgcggccgc

SEQ ID NO: 293664 - DNA, 2246 bp, Homo sapiens
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293665 - DNA, 1903 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293666 - DNA, 2053 bp, Homo sapiens
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293667 - DNA, 1816 bp, Homo sapiens
gcggggggaggcgcgtcgaggcagcgtcctccttttgtgcgagcgccggcggctcggcttctcgaaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293668 - DNA, 2306 bp, Homo sapiens
tggacgacagagcaagaatttatctgaaaaaaaaaaaaaagagatgagtttccttaagacattgcaaagccaacaacccccccggggagccatattaaagcaccaatgggaaatttcgtcagcagtgcttaatcaaaggcattgattgttttctgggccccactggttcctgtcccattattgtccttaattgtggaaacttgttcattagggtttcattaaggctggccctggctgttacccctcctttgctctctttgatctctgcaaacaaacaatcaaacaaacaaatgctatttggagttgttattcccaaactgtacctctactatgggaaaaaaacaatagctaggatttaccgggggctttctgtgtactgagaactgttgtaacttgcttaatccttgctataactcttttacaggagaagaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293669 - DNA, 2279 bp, Homo sapiens
tggacgacagagcaagaatttatctgaaaaaaaaaaaaaagagatgagtttccttaagacattgcaaagccaacaacccccccggggagccatattaaagcaccaatgggaaatttcgtcagcagtgcttaatcaaaggcattgattgttttctgggccccactggttcctgtcccattattgtccttaattgtggaaacttgttcattagggtttcattaaggctggccctggctgttacccctcctttgctctctttgatctctgcaaacaaacaatcaaacaaacaaatgctatttggagttgttattcccaaactgtacctctactatgggaaaaaaacaatagctaggatttaccgggggctttctgtgtactgagaactgttgtaacttgcttaatccttgctataactcttttacaggagaagaaactgaggcctggaatttgattaactcattcaaggttacccagttgatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293670 - DNA, 2443 bp, Homo sapiens
tggacgacagagcaagaatttatctgaaaaaaaaaaaaaagagatgagtttccttaagacattgcaaagccaacaacccccccggggagccatattaaagcaccaatgggaaatttcgtcagcagtgcttaatcaaaggcattgattgttttctgggccccactggttcctgtcccattattgtccttaattgtggaaacttgttcattagggtttcattaaggctggccctggctgttacccctcctttgctctctttgatctctgcaaacaaacaatcaaacaaacaaatgctatttggagttgttattcccaaactgtacctctactatgggaaaaaaacaatagctaggatttaccgggggctttctgtgtactgagaactgttgtaacttgcttaatccttgctataactcttttacaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293671 - DNA, 1817 bp, Homo sapiens
gtctgctcctccttgttcccatgatgccccagaggagccaaggccaagaggagccaagcccagagcaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293672 - DNA, 2087 bp, Homo sapiens
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293673 - DNA, 1983 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtttgctggcatgggtaatctcattaaggtgctaaccagggacatagaccacaatgcagcacattttttcttggactttggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293674 - DNA, 1777 bp, Homo sapiens
gcggggggaggcgcgtcgaggcagcgtcctccttttgtgcgagcgccggcggctcggcttctcgaaggagaagaaactgaggcctggaatttgattaactcattcaaggttacccagttggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293675 - DNA, 2253 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtttgctggcatgggtaatctcattaaggtgctaaccagggacatagaccacaatgcagcacattttttcttggactttggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293676 - DNA, 1820 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293677 - DNA, 1970 bp, Homo sapiens
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293678 - DNA, 1907 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293679 - DNA, 2537 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaaaaaaaaaaacaaaacaaaaaaaaaaaaaacaaaaaaaaaaaaacaaaaaaaaaaaaaaaaaaaaaaaaaaaaaaaaaaaaaaaaaaacaaaaacccaacaaaacagggggggcagaaaacaagcacacagggagcagctcaagcaacatgcgcacacagagtaaaggacaacgagcggaagagagcactcagccaagaagcaaggaacgcgaacacaccgcacgaaacgacagcacgacgagagtagacaacatagaccaaggcagaagcaaaaagaagaaacacaacgacacgagaacagaggaacaagaaaacagcaacaactatcaccctatagggtgtagagtgacaatagccaacagagagaagagaaaagacaaacgcaacggggaagcacgaaaccacgcacggccacggcaagagcgcgcagacgcacaagacgacaaggacaaaaccgagcagagagagctggagaagataggtgaagcaaaaacaaacgagagtacagttaacacagggcagcaggcagaagaggaagacggccagcagcggcacacggaaacataaaaacatgagaaaagaaaaaagacaaaagtgagaagtaacgggaggggccggacagagaggagaagga

SEQ ID NO: 293680 - DNA, 2005 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaaaaaagtcaaaatgcaaacttaaaactttaaacaaaagtattactaatttaaaaaaagtttgtgttgggtaccgtcgacgcggccgcgaatttagtagtagta

SEQ ID NO: 293681 - DNA, 1922 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaatgcaatcatgattgcatttagacctagtatggtctatatcgggatcgcgacttgttcttttcgtg

SEQ ID NO: 293682 - DNA, 1847 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcagtgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293683 - DNA, 1859 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgattgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 293684 - DNA, 1947 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaaaaaagtcaaaatgcaaacttaaaactttaaacaaaagtattactaatttaaaaaaagtttgtgttgggtaccgtcgacgcggccgcgaatttagtagtagta

SEQ ID NO: 293685 - DNA, 1588 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgattgtaagttattgttttatataaataatttcaaacgagtttctccatggaaaccataggattttattttatgataagagccagcaaaccggactctcacaaaactcagatttatagtttgtgaaatggtggactttcatctcctctgtccctgtgctgtttttcttgtggcctgtattcaggtggaatagaatgatcaaaggatgactatattgtctagtgagtacctcctggaaggcttctactacgtatttggcaatataaatagataattagatataaggaattttgagtcatatcctttaattcctttggccaaaggccatttcaaataaaatgtttatttcagaatgcatataaaaagtcagtagtgctgctgggcgtgctggctcatgcctgtagcccaagcactttggcaggctgaagcaggaggatcacttgagcccaggagtagaagaccagcctgggcagcatagtgagacccccatttctac

SEQ ID NO: 293686 - DNA, 1117 bp, Homo sapiens
cgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagcaatacacaatttcccttgaaatccccgattgtgttagccccaggtttgtgttccaagtcttctgggaacccggatacaacgcgttacattaaaaacgcccgtgaggaagaggggtaaaacttcacacaacacggggtcta

SEQ ID NO: 293687 - DNA, 1027 bp, Homo sapiens
  misc_feature (842)..(842): n is a, c, g, or t
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcngaaccgcgaacatgacgtccctcctgcattgggcacctcgcctgctcttcgcgccatgcctcgccgcccctccgttgctcgaaccctgcactgctgccccaccccccggctcccacccttccctttcccctttccccctcccccctcgcctcacccccgggtcccgcaccgcccccccgcccccc

SEQ ID NO: 293688 - DNA, 1367 bp, Homo sapiens
tggacgacagagcaagaatttatctgaaaaaaaaaaaaaagagatgagtttccttaagacattgcaaagccaacaacccccccggggagccatattaaagcaccaatgggaaatttcgtcagcagtgcttaatcaaaggcattgattgttttctgggccccactggttcctgtcccattattgtccttaattgtggaaacttgttcattagggtttcattaaggctggccctggctgttacccctcctttgctctctttgatctctgcaaacaaacaatcaaacaaacaaatgctatttggagttgttattcccaaactgtacctctactatgggaaaaaaacaatagctaggatttaccgggggctttctgtgtactgagaactgttgtaacttgcttaatccttgctataactcttttacaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaaacaaactaaaaaaagaaagtcagagaaaaaagtcaatcgaagttcctcactggatactagaagagggagagagagaaggcgggaagacatagaagaaaggacgaaacagaggaaaaggaagaagaagaaagaaagcacacagcacaaaaaagggaagaagaaaacacaaagagagaacaaggaagagagcaagaacaaagaaagaaaaaaggaggagggtacaaagaaagaagagagaaagagaagaaaggaaaaagcaagcggagaacaaaaaaaagaaagaagaacagaaggaggaaagaaaagcagg

SEQ ID NO: 293689 - DNA, 597 bp, Homo sapiens
gcggggggaggcgcgtcgaggcagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggcccagtcccagggcgcaaggctacttgcgtcagcagcgtgccgaagcaagatagcggaatcaggaagagagccggccggaagacacctgccctggccggaagatacgtacccctgaagatcgagaaagaggccatccgggtatcacgtagcagtttcgtacgactaggagacttcctgttacaggagactatgaaacctttgttccgtcctcacttggggctgacgccattttaggcctcagcccgcctgcatccaggcgctcattaaaacagcatgttgctccacaaaaaa

SEQ ID NO: 293690 - DNA, 481 bp, Homo sapiens
actttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaagtgtggcttggtttactgatgttttgtttttaggcttctgaagttttccccatgtatgtttttatggaatgcatatatacattacatgattttttcttcttttaggggagagccgggtcttttcattagaattttgatcattgtctatgtatatacttttaattgcctttaaaattttgctaagtatattaa

SEQ ID NO: 293691 - DNA, 5074 bp, Homo sapiens
cgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgatgcagcggactcggcagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtcatgagacagaaataagccacctcagagtgatggctgggttcgttcattcatctactcttcagtcaacaaacacttactgagaagtggctgtgtgccaggcacgctttaggtgctggggttgcctccatgaacaaaacaagcagaaaactctgctgctgtgaagcaagctaaggcggagcccagcatggcaggggcgggaggggctggctggcaagacattgcttcctgccctccccccaggggcaccacacagaacagtttacaaagcactcccacggttgcgttcccattaacaagccttcgcccccaacacaagcctttcctctcctagtccccgggacggtgtcagccctgaacatagcccaggctgggagagtggggggcttacacccttgggtgacttaatgtgcccactggcccaccctgcccaagacctaccacttctgccctctcagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtaaaaaaactaga

SEQ ID NO: 293692 - DNA, 775 bp, Homo sapiens
cgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgatgcagcggactcggcagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtccgctgcattgggtcctctaga

SEQ ID NO: 293693 - DNA, 445 bp, Homo sapiens
aatcgagcgctgaccgtctgagcagctgggaaaactctgggggctcagggtggggcgtgggtgtggaggtggtggaaggtgggcagagagacagcaagggcgcccctggtgagctgggccatgttctctttcccgaggctgtcctggggcggaggtgaccttgtgcgttctgggctcccccagcacctttctgcctgtgctgctggagggtggggtccagagcccgggtgagtgtatgctcaagtttccccatccccttctacagaaagggcagccctgccctggcccagccacagaactaatcatattttatatcttcttcgaaaccacacttatccccaccttgggtatcatcacccgatgaggcaaccagccagaacgcctggacgcaggcacatacttcctattctacaccctagtaggctcccttcccagcttgctcaga

SEQ ID NO: 293694 - DNA, 2350 bp, Homo sapiens
gtgtttgtgtactcgtatcccctgaaggggccatcctaggccccatcctatccccctagcacccagtactagctgacctggatatgccccaccctgtggcttctgcagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtaaaaaaactaga

SEQ ID NO: 293695 - DNA, 3956 bp, Homo sapiens
cgggcgctgtgccactgccaccgccgccgccgctgcatcccgcccggtccgaatccgcccgccacgcccgccgagccgctgccgccgccagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtaaaaaaactaga

SEQ ID NO: 293696 - DNA, 4867 bp, Homo sapiens
  misc_feature (4857)..(4857): n is a, c, g, or t
  misc_feature (4860)..(4860): n is a, c, g, or t
cgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgatgcagcggactcggcagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtcatgagacagaaataagccacctcagagtgatggctgggttcgttcattcatctactcttcagtcaacaaacacttactgagaagtggctgtgtgccaggcacgctttaggtgctggggttgcctccatgaacaaaacaagcagaaaactctgctgctgtgaagcaagctaaggcggagcccagcatggcaggggcgggaggggctggctggcaagacattgcttcctgccctccccccaggggcaccacacagaacagtttacaaagcactcccacggttgcgttcccattaacaagccttcgcccccaacacaagcctttcctctcctagtccccgggacggtgtcagccctgaacatagcccaggctgggagagtggggggcttacacccttgggtgacttaatgtgcccactggcccaccctgcccaagacctaccacttctgccctctcagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctcccctcctctgtcttccacctcctctgtgctgggatcntcnagatcac

SEQ ID NO: 293697 - DNA, 452 bp, Homo sapiens
aggtggagaccctaagtaggacagttattttggaagggctaccctctggctggctttcctgatccgtgcgctcagagctggaaggtggcccacgtcctacttttgcggttgggtcatatcaaatctgtatcggctaacgggaaggaagttacgagcaagttccaccggaaagaaaatctagcgcggggactgcactcgaggccgaggagagggcagcgcgtccgtggtggggtcgcccagcactgcgagccgcgctgaaccccacccccggcctgcagggtgcggctccctggctgccccgtggacccggccagcccgggacgaggacgcaggacctcggcagggacgccggagccagcccttcgccatccccacacgccccgcggcacagtggccgcgcgcacgttacctgcggagcccggccctgcccgcccgtctgggctgccgccctc

SEQ ID NO: 293698 - DNA, 4862 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagaga

SEQ ID NO: 293699 - DNA, 2269 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293700 - DNA, 3009 bp, Homo sapiens
  misc_feature (13)..(13): n is a, c, g, or t
agcaatgagccangtagttaaaaaaaaaaacaactcatcttccccctcttcatttcccttatttaaaaaaaaataataactggtagtcctcaaactaatatacccctgttcttctggaaaccactaaaaaagttgtttattgtaataatgatgactcagagaaacctgggcagcagtgccagtttgggtcatcatgggcttctgtctcagagttctgagtcctgcagttgacttgccttcacttctaatctatgtgttgtcatgcataataaatatgtgcatgtttaaatattttacttaatttctagttcgccacaagtcttgacatgttttcctttgtggatttttctgtctcagcagtgcagaaactgagtttcctctctcccctggcgtttaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcaggtacggtagaggagcgacactagcttgagtcttcatggcatcatgtcatactccaattgccaacaagtggtcacgatgccagccaacacctaaaattgagtcgatagcttattcctttatggattagattcagcaggtatagcagacacagcctggcagcagctatcaaaggtgaattgaaatgtctctgagttggctcccatagtccccaggattcatctgggtgccacgtgattgatcagggactctggctcttttggactggctgagatcttacagatgccacttctggagtgttttccccactaaacttgaagatgactaaattggccagtaaaagggctctgaaaagatgttttgattggaaattaaggacatggtagctgtcaaaactcaagctggttatgctttgtaccctatgttccaaggagatgctattgctgttggttttatctgttctgttttctcttaaagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggtgggtaccttgggcccttccctcaatggctctgtgaggatgaggtgtgagtttgtcctgaagatggtcattttcacttagaggatttcctccagtcctggagcaaacaggctgtttgggaaaacccacagcttctttgccttgttgctgccacctgccactgacgggttcaacccatccacgctgcttccaagtgatcaataccagatggaggcctggacactctcaagctgtttttggctcacagggcagagtacagatgagtgacctcttacagtcgcccttgaactccccttctcctgccacacacacacccaaatgaaaaatacacaaatgaactacacccaaatgagaagcttctcaccactacttttgatgtggtatcactttagtaaatactacaagtggattattcatactaaaaatacaataaatactgctacttacctgattttattttgagcctattttcagtgcatccaagaggattatagttcgaggcccacatgaaggccatagcctcctggtgacaccaagagtctttgctctagtactgactaggtaattgttaactagagataatacatgcataaatgttctgcagagtaatgagccctcagcctactggctctgtaaaagctttgagtattaataagtctcagtggagttggtattcctattggacattgcaaaggtgcttcagctaagaactgagacgtttttccccatggggaattgaaaattgtttccacccccttgctcctcaggaagaagtttctcagcagcaggaaagcgtctccactctccctgccagcgtgcatccccagctgtccccacggcagagcctggagacccagtacctgcagcacagactccaggtgggtccttctccttgcgagtccacctcactctgctcatccagaatctgttcttctgcaaagcagaaacgtgttttgcctggcatttatttagggtagctgcttgattccttataggcaagtagctttgactctgtacttggagtttctagaaacgtgttcagatctagctttgtgctgtgtgttggtggtgggaaaggctttgtcctcaagccccacgaaaggatatgccactgaggggtgggaacgggagacctggcttctttctttctaattgtattcctcttaatgagtaacaaataaaatgaaaaccttaagtctgcagaatttctacatgggctttctatgttggtgcataaaaatcttaaaaagcgataaagcatagatcccgtaaaggatgaatcattcattcagcgggtgctggggcctttgctctcaagatctaa

SEQ ID NO: 293701 - DNA, 640 bp, Homo sapiens
aaagagacaaatatgtttgttgaattgaacgaggaacattcttgattcctcacaaaagctagctttctcgtcacctgcgtgaaagtcaagcatcccctcatgaggcagaaatgaaattctgtacgacctctttcagagtaaccgattgctgagtctgcttcagatcactgtctgcaccatgtatatatttcactaaatctttctggagtttccaataaataaatattcattctttaattgccacaggaagaattattttattcttagaactttgtgtatttatagagaaggtattcatgttcccaaactgtctgttcttgccatatttacaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtacggctatgtttgagagtctcagaactggcagtttggcgagagatttcagtttggtccacaagtgttgtactttggctttattgaactttatcatttcgttaagtcactcaggagtgatgcttttgtggagaaaaacctta

SEQ ID NO: 293702 - DNA, 6950 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293703 - DNA, 7505 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaaaaacaaactaaaaaaaaaaaaaaacaaaacacaaactatttcctataaaactttctccatatcatttaaaaaaaacctcttcacctccttttcttactctatatctcttatactctaaacaccccacaattctattcttttttctcctaaaaaacattttctttacatatttattcttacttctctcttccataaaatctacttttatactaaacaatcttttcttcctcctttttaataaaaaaaatttctcttacctccacttttaattttctttttctacaccaatatcttcttcaaatctcttcaacctactttttttaaattacccttcctctaaccatttttttccccatttttaaatcaaatacaactttctccccttctctacctttttcaacaatctcttactattctaaaacctttcaaaaa

SEQ ID NO: 293704 - DNA, 6924 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctcctaggaaagaaaaagtcagtggccctttcttcctcagatatcaagaactcccaagtgtttaaaccgtatgctggagtcagtggttgggacagacaggagcccaagactgaagccagcccttgcctcttgtgtcccttcccaactctggtgctggagtaatggggtgctctgcattttgatggggagcaaggggggaccccccctgtaggagtatcggcctctcccctgccccctaccctctctcgtggaccaaagtctccagcagaagggactcatcataagactgacgactcccccacctccacccacacaccgagtgtcatcagtcctaaaggcagggaaacgctcacagaattctgcccacgggttagatgtggggagaaggatattctcagctccagagtgattaggtgatcagccagaaactaaggcaaggtgacaagcagcagcctggagtcacagttggtcccaggcgtgtgggcactaagcagcctctggagacatgcgggcagttgaggatgcaaggacacagtgagtgagtggcgctcctttttggggtcctccagcctctagtcaagccccaggttcgtaaatatgtttgtattacattttaaaacctgtatcaacagtcacatttaagctccctattggtttaaagaaaattcatactccaggtaactttttcccattcgacctcctatagagacaatatgcagtgtgtcatttcacagtctcagtccctgtgaacagtggctgacaccggtgccagggctgacctgctacactca

SEQ ID NO: 293705 - DNA, 5099 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293706 - DNA, 7086 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293707 - DNA, 7853 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggtgggtaccttgggcccttccctcaatggctctgtgaggatgaggtgtgagtttgtcctgaagatggtcattttcacttagaggatttcctccagtcctggagcaaacaggctgtttgggaaaacccacagcttctttgccttgttgctgccacctgccactgacgggttcaacccatccacgctgcttccaagtgatcaataccagatggaggcctggacactctcaagctgtttttggctcacagggcagagtacagatgagtgacctcttacagtcgcccttgaactccccttctcctgccacacacacacccaaatgaaaaatacacaaatgaactacacccaaatgagaagcttctcaccactacttttgatgtggtatcactttagtaaatactacaagtggattattcatactaaaaatacaataaatactgctacttacctgattttattttgagcctattttcagtgcatccaagaggattatagttcgaggcccacatgaaggccatagcctcctggtgacaccaagagtctttgctctagtactgactaggtaattgttaactagagataatacatgcataaatgttctgcagagtaatgagccctcagcctactggctctgtaaaagctttgagtattaataagtctcagtggagttggtattcctattggacattgcaaaggtgcttcagctaagaactgagacgtttttccccatggggaattgaaaattgtttccacccccttgctcctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293708 - DNA, 7032 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacatagtaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293709 - DNA, 5144 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagaccccataccaaataaacaaaaaaatctttc

SEQ ID NO: 293710 - DNA, 5556 bp, Homo sapiens
tacaggatccttaagcgaacatgcgggacagctcatgagtggtatacgtcttcagaggacactaatattcggattgttatttctattggcagaacaatctcgattgtctacttctagtaggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293711 - DNA, 5095 bp, Homo sapiens
tcgctgctctatgatgaacccttcgactgtggactcagagtacaggcgcagactcatcagactgcgtccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggcaagaaactcaagaacgcatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293712 - DNA, 6752 bp, Homo sapiens
ggcggcgcgcgcctggctgggccctggggagcgggagggaaggagcgaaggagcgaaggagcaagcggagcggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtcttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagagcaccagccctgggccagggaagacaggctcttcctgcagtttctcgtggacactgctggcttgcgggcagtcggtctccagggtacctgttgtctcttttccgatgtaataactactttgaccttacactatatgttgctagtagtttattgagctttgtatatttggacagtttcatatagggcttagagattttaaggacatgataaatgaacttttctgtcccatgtgaagtggtagtgcggtgcctttcccccagatcatgctttaattctttcttttctgtagaaaccaacagtttccatttatgtcaatgctaaatccaaagtcacttcagagtttgttttccaccatgtgggaatcagcattcttaatttcgttaaagttttgacttgtaatgaaatgttcaagtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacgaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttaaatctggggtattagtctgtgctttgggagaaatgcactagctctgcaattcccagctgggcaagtgtgtctctagtatctccacgcaactgatacactggtccctgtaaggcaaacagcatgttagcccgacaggaagagggggcccactttcacattcccggtgacactgaccgtccccagctgccccctcgccacctctgcctgcactgccttctgtcaccgtgggaaaaggaggctgatggttctctacaccatccaccttgagaatccctgcgtgggagagcatcagggcccaccaggggagtggggatggggctcaggggctgttcatgcccatctgagcaaaccccttctctcttccatccacttttgcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293713 - DNA, 2091 bp, Homo sapiens
aaacatgaaaggtgaaaattggagaacagggaagctcgtaagttggagtcattgtacaggctgaggcaggagaatggcgtgaacccgggaggtggagcttgcagtgagccaagatcgtgccactgcactccagcctgggcgacagagcaagactccacctcaaaaaaaaaaaaaaagacaagagcagtatcatctgcctctgtttctaaactggacaaagagattttcttaaagtttctatcatctcccttctgacaggttctacagtgtggtctgaagcacctgtaatgtcagagcccttgtctggcccttggtggcaggtgaacgaaagcagtggagcctctcaccttccagtagcctctcacattcttattttaccatttttgtcctaattaaggtagcctagctgattctagaagacagccatcctacgtgcacccccaccttgtgtccacatcttctccaggcaggtttcaacctatcagcagactcaggcacacactggggcacagatagagaaccaggcggcagcagtgctcgcagacccacccagggagagctgtgatgggttctgcccagatactctgctcgcccacccacaagggagcaatagcttatatttgtacattagttttaccaagcactttctcttctaaccctcacaacaattctatgaaattagctggggagatactgtccttatttttcacagctgaagaaaccaaagctttgggaagtttgtgacttctctgagatcacagctggtgatagaaggagctgggacacgcgcttgggttgactggcttctggttttggttctctggcttctagtgctggaagaagccctctctttcccttctctttcctcagtagcatctgactcttttcataagcaaacagctgtataaacaaagcccccattttggtcaagcacagggtgaatgtgatattgttcccacaaccttattctccactcaacagccgcctggctttggggaagaggccgccttcaggtgacagtgcagctgtccaggtggccgtgcactgaaccaggctgagggagacaaaaaccccgcagacccgcctgcctttcagcgtccagttaactgcagaagtttaggctcacctcaaagatgtctagtttttccaagttacaatacagcagtttcctacagaacacccccttcctcaattgccaaggggccgcatcgcacggcatcaggccaccactgcaggccagcagattccaccccaggaacggtcatgaactcagcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293714 - DNA, 2126 bp, Homo sapiens
accacaagagtgagccacagcatccagctagtttgtatatcccaagaaacgccgggcgtggtggtgggcgcctgtagttccagctactcgggaggctgaggcaggagaatggcgtgaacccgggaggtggagcttgcagtgagccaagatcgtgccactgcactccagcctgggcgacagagcaagactccacctcaaaaaaaaaaaaaaagacaagagcagtatcatctgcctctgtttctaaactggacaaagagattttcttaaagtttctatcatctcccttctgacaggttctacagtgtggtctgaagcacctgtaatgtcagagcccttgtctggcccttggtggcaggtgaacgaaagcagtggagcctctcaccttccagtagcctctcacattcttattttaccatttttgtcctaattaaggtagcctagctgattctagaagacagccatcctacgtgcacccccaccttgtgtccacatcttctccaggcaggtttcaacctatcagcagactcaggcacacactggggcacagatagagaaccaggcggcagcagtgctcgcagacccacccagggagagctgtgatgggttctgcccagatactctgctcgcccacccacaagggagcaatagcttatatttgtacattagttttaccaagcactttctcttctaaccctcacaacaattctatgaaattagctggggagatactgtccttatttttcacagctgaagaaaccaaagctttgggaagtttgtgacttctctgagatcacagctggtgatagaaggagctgggacacgcgcttgggttgactggcttctggttttggttctctggcttctagtgctggaagaagccctctctttcccttctctttcctcagtagcatctgactcttttcataagcaaacagctgtataaacaaagcccccattttggtcaagcacagggtgaatgtgatattgttcccacaaccttattctccactcaacagccgcctggctttggggaagaggccgccttcaggtgacagtgcagctgtccaggtggccgtgcactgaaccaggctgagggagacaaaaaccccgcagacccgcctgcctttcagcgtccagttaactgcagaagtttaggctcacctcaaagatgtctagtttttccaagttacaatacagcagtttcctacagaacacccccttcctcaattgccaaggggccgcatcgcacggcatcaggccaccactgcaggccagcagattccaccccaggaacggtcatgaactcagcctttgtctcaacgaggggcgtaacatttccttacagtcaagccccatcaactagaagtgcttattacttttaggattaaaaaagtaataacagactttgacttaatactctgtcttttcagaggcaaagtgggtgggtagaggggagctttaaaaatagaagtacaaaacaacatcctggaaacatatgaccccagatggaataatgtcacattccccagtgcagataatgggctgctgctggctctgtggtgtctgtctgcagaagatttgctcagtcaaggaaattcaagtggtgagacctttccaccatgggtggtaagagaaacctgccttcaccaaaatctctgaaggggaaagaagtggagagaaaggtttgcttcacttcggggactgcagtttgagaaataaaagggatacagagatatctgcactttgtagaaagggcaagattatttgcttatatctgaagggaggtgggtggttttgctggatgtttggtctgaaagagttacttttgataaagttaatctaattgtagttatattttctgtgtgcttttttttaattactaagaaaaaaattggtgagttcagtagctttggtattatgagtgcaaatcataatagctccaatgtgaaaaaaaaaatcaaaagtataacttgtcacttaatgttagaaaattgcctaaaatgcagtgtaataaataatctctgtaccaaatagtaatttaaatggggtaattttctgcaaggaaaatgtactgtttttatgtttccaaccctcttgaattaaaataaaaacaacttcttttctaa

SEQ ID NO: 293715 - DNA, 1243 bp, Homo sapiens
gggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgcttaaagt

SEQ ID NO: 293716 - DNA, 348 bp, Homo sapiens
caggttagtattttgtaaatttgtcaaaacacagatacagtggaaacactaattttttatgcaaaaaaagttcttaaaatacagtttaactacgccgcactccagaaagtggaaggactggttgatggtcacaaacagctgaagatactacttgtatctctcaggattttcaaatgctagtattttgagcctttcttttggtaaggaaatatacagttgcatttagataatatagaaatgtccaaagaagaaataaaaataacttagaatccatagataactattgttaaaattatagtgtgttttcttttcactctttttttccattatgtttcagtttgattgtcg

SEQ ID NO: 293717 - DNA, 1298 bp, Homo sapiens
gcaggagccattttagaaataaatatcttcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293718 - DNA, 5694 bp, Homo sapiens
ttcagagtcccttgaaaatgaacctgaaaatctagtgagagtagaaagcagagatgatcatctcagcctgcctgatgtgacatgtgaaaactttatttctaaagttcaggatgtcatttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggaccgcgtgataattaaccgcctagataatatctgccacgtggtgttaaaggggaagtggccctctagccagcagtatgagccctcaggcacactgcccaccccggtattaaccagcagtgctggttctcgaaccagcctctcagagccggaagcagcagaacacagcttcagcaacggcgcagcattggcggcccagatccacaaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293719 - DNA, 4023 bp, Homo sapiens
  misc_feature (5)..(5): n is a, c, g, or t
cattnggtaaccgttcgtacgagaatcgctgtcctctccttgcggccgccagtgtggtggaattcgagttaaagtgtaccaagtggacaagagcgggagaggagtgctcaggtgaagggaacaccaaatcacttgcaagagcttatgtgggcgtgggtcagtggtgtgtgtagggttctaattcaggcaccccagctgagtaatatcagggtggaaataggtggagtgattcaaataacaccttacatgttttctttctttagaaactaattttcattgtgtcgtgattatacatactcgtttttccttcatccaggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293720 - DNA, 3969 bp, Homo sapiens
  misc_feature (5)..(5): n is a, c, g, or t
cattnggtaaccgttcgtacgagaatcgctgtcctctccttgcggccgccagtgtggtggaattcgagttaaagtgtaccaagtggacaagagcgggagaggagtgctcaggtgaagggaacaccaaatcacttgcaagagcttatgtgggcgtgggtcagtggtgtgtgtagggttctaattcaggcaccccagctgagtaatatcagggtggaaataggtggagtgattcaaataacaccttacatgttttctttctttagaaactaattttcattgtgtcgtgattatacatactcgtttttccttcatccaggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293721 - DNA, 3967 bp, Homo sapiens
  misc_feature (5)..(5): n is a, c, g, or t
cattnggtaaccgttcgtacgagaatcgctgtcctctccttgcggccgccagtgtggtggaattcgagttaaagtgtaccaagtggacaagagcgggagaggagtgctcaggtgaagggaacaccaaatcacttgcaagagcttatgtgggcgtgggtcagtggtgtgtgtagggttctaattcaggcaccccagctgagtaatatcagggtggaaataggtggagtgattcaaataacaccttacatgttttctttctttagaaactaattttcattgtgtcgtgattatacatactcgtttttccttcatccaggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtggggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293722 - DNA, 3300 bp, Homo sapiens
  misc_feature (5)..(5): n is a, c, g, or t
cattnggtaaccgttcgtacgagaatcgctgtcctctccttgcggccgccagtgtggtggaattcgagtgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaagaaaaa

SEQ ID NO: 293723 - DNA, 683 bp, Homo sapiens
ctcttagactttcaaagtaatctgggaagctgaagtgacacgttctttccctgctcaatcctgcaagcttttaagaagtcttttaccttttttagatgtgcaacaccatagtttctctataatgatcatagaattccaatggaatgaccgataaaaattttcccccttgtcctcagagtatttttttaatttattgatgcaaacacttatttagcatggtcattgttatagaccccattataggcattagtaaaacagaggtaagacaggcattcaaactatagagggtgagtaaattgtggtatggcgttttctttatgtgagagagctaggaaccgagtgctgtggggacaggagctggagcagtgagtgctgcctgggacagtgggcagtggtgacagaggaggaaaactgaatccggcagtcaggatggagttaaagtgtaccaagtggacaagagcgggagaggagtgctcaggtgaagggaacaccaaatcacttgcaagagcttatgtgggcgtgggtcagtggtgtgtgtagggttctaattcaggcaccccagctgagtaatatcagggtggaaataggtggagtgattcaaataacaccttacatgttttctttctttagaaactaattttcattgtgtcgtgattatacatactcgtttttccttcatccag

SEQ ID NO: 293724 - DNA, 366 bp, Homo sapiens
caactacaaaaaacgttatgaaaaatattggattatttcccacaaggactctttaaaatttagtctaaagagtaatccagctgggcgcggtggctcacgcctgtaatcccagcactttgggaggccaaggagggtggatcatgaggtcagatcgagaccaacctggctaacacggtgaaaccccgtctctaccaaaaaaatacaaaaaattagccaggcgtggtggcaggcgcctgcagtcccagctactcaggaggctgaggcaggagaatcgcttgaacccgggaggcagaggttgcagtgagccagattgcaccactgcattgagttagactcagtctcaaaaaaaaaaaaaaaaaaaaagag

SEQ ID NO: 293725 - DNA, 1461 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaaaaaaatata

SEQ ID NO: 293726 - DNA, 1326 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaaaaaaatata

SEQ ID NO: 293727 - DNA, 1724 bp, Homo sapiens
gaagggaggagcgtctctgcccagctgcccatcgtctgagatgtggggagcgcctctgccctgccgccccgtctgggatgtgaggagcgcctctgcccggccgcgaccctgtctgggagatttctaagtggggctcaggaattataatagatgtccacagctgcatggtcttctctctccacaacacgcagacactattagaggtaaaagccacgtgtcctcaagagggcaaggcaaagcatcttcagatgtctctgcccttaaagcacacgcgttctgctctgcgacgaagcaggacaaggaggacagggacctgcacctccggaggcccgcacctacgaagatagcgggctcgggaccttcggtggaccggcagggttccagaggcccgcgcgccgccgccccgccctcattgctgagcctgccagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaaaaaaatata

SEQ ID NO: 293728 - DNA, 1380 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaaaaaaatata

SEQ ID NO: 293729 - DNA, 1531 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggtaaagtcagcttactaactttggggaaaggaatattaagtcatcataccaaaagttttttttattataggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaaaaaaatata

SEQ ID NO: 293730 - DNA, 388 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtacttctagagcggccggcgccattcgatttcccacccggg

SEQ ID NO: 293731 - DNA, 4358 bp, Homo sapiens
gccgagatcgtgccactgcactccagcctgggtgacagagcgagactctgtcaaaaaaaaaaaagaacaaaagaaagagaaagaaactgtcaaactgttttctggagtggctataccattttgcaatcccaccaaagtatgagagatccagttgttcagcaactggattccaccctggttttaatttgcgtgtccctgatggctagtgatttgaacatcttccacgtgcttttttttttttttttgtcttctgtatacctctttggtgaagagtctgtttaactcttttgctcatttaaaaaattgttcgttttcttaccattgagactttctttagaaaacaactttattgaggtataatttacataccataaaatccacccatttgaagtacaattcaaagagttgtcgtaagcttaccaccagaatccagttttagaacatctgcatcaccccagtaagacccctcatatgcatctacacttagtgttgagttttgagagttccttatacattctggatacaagtcctttgttggatatataacttacagtattgtcccaatgggggacatttgccaagagttgagaatgctgtaattggaggcctgagaggtgggtcccaattcttacattttccattccacaaactgtctccttttgtttggttttaatatgggtaaacagcacattctggaaataataaaggtgactctccatttgctgaatgccaggaggagagtttatgacagaacttcctcctgcaataaaaggatgtcaaagaagccaacatcaaggtgccccccatccctggtgggtggtcagagagggcaggaggctccagggcaccctgcctggccaatcagtgcacattcttggggttgcagatggtggcggggaaggggacaggttctgcaggggactagggtgggaaccccattgccctctcagattgctccatcagaagagcagatgaggctgcacacagtggctcacgctaaaatatttaacaattatttaatagcatgagatacacaaggcgtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattatactatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactacggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgtccccttaggagcaaaattgcccctggttgagaaacattgctttagacaaattgttaagagtatcatgtactacacttctgaaacttaacgtgatcatcaccactgacagatgattcacagagagagactgtttgaatcttgtctcactagtttttcctgtgcaaaaataaaatggacagaattgca

SEQ ID NO: 293732 - DNA, 3331 bp, Homo sapiens
acgaggttcatcttgcagggccagcgcccccggtctcattgtacggggcctgcacctcgcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattatactatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactacggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgtccccttaggagcaaaattgcccctggttgagaaacattgctttagacaaattgttaagagtatcatgtactacacttctgaaacttaacgtgatcatcaccactgacagatgattcacagagagagactgtttgaatcttgtctcactagtttttcctgtgcaaaaataaaatggacagaattgca

SEQ ID NO: 293733 - DNA, 3203 bp, Homo sapiens
aaacttacggttaggtacgaggctgggtgtttaattcggccgagggccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattatactatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactacggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgtccccttaggagcaaaattgcccctggttgagaaacattgctttagacaaattgttaagagtatcatgtactacacttctgaaacttaacgtgatcatcaccactgacagatgattcacagagagagactgtttgaatcttgtctcactagtttttcctgtgcaaaaataaaatggacagaattgca

SEQ ID NO: 293734 - DNA, 3361 bp, Homo sapiens
gccgagatcgtgccactgcactccagcctgggtgacagagcgagactctgtcaaaaaaaaaaaagaacaaaagaaagagaaagaaactgtcaaactgttttctggagtggctataccattttgcaatcccaccaaagtatgagagatccagttgttcagcaactggattccaccctggttttaatttgcgtgtccctgatggctagtgatttgaacatcttccacgtgcttttttttttttttttgtcttctgtatacctctttggtgaagagtctgtttaactcttttgctcatttaaaaaattgttcgttttcttaccattgagactttctttagaaaacaactttattgaggtataatttacataccataaaatccacccatttgaagtacaattcaaagagttgtcgtaagcttaccaccagaatccagttttagaacatctgcatcaccccagtaagacccctcatatgcatctacacttagtgttgagttttgagagttccttatacattctggatacaagtcctttgttggatatataacttacagtattgtcccaatgggggacatttgccaagagttgagaatgctgtaattggaggcctgagaggtgggtcccaattcttacattttccattccacaaactgtctccttttgtttggttttaatatgggtaaacagcacattctggaaataataaaggtgactctccatttgctgaatgccaggaggagagtttatgacagaacttcctcctgcaataaaaggatgtcaaagaagccaacatcaaggtgccccccatccctggtgggtggtcagagagggcaggaggctccagggcaccctgcctggccaatcagtgcacattcttggggttgcagatggtggcggggaaggggacaggttctgcaggggactagggtgggaaccccattgccctctcagattgctccatcagaagagcagatgaggctgcacacagtggctcacgctaaaatatttaacaattatttaatagcatgagatacacaaggcgtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagctggagtgcaatggcgtgatctcagctcaccgcaacctccgccacctgggttcaagcgattctcctgccgcagcctcccaggtagctgggattacaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 293735 - DNA, 3536 bp, Homo sapiens
gccgagatcgtgccactgcactccagcctgggtgacagagcgagactctgtcaaaaaaaaaaaagaacaaaagaaagagaaagaaactgtcaaactgttttctggagtggctataccattttgcaatcccaccaaagtatgagagatccagttgttcagcaactggattccaccctggttttaatttgcgtgtccctgatggctagtgatttgaacatcttccacgtgcttttttttttttttttgtcttctgtatacctctttggtgaagagtctgtttaactcttttgctcatttaaaaaattgttcgttttcttaccattgagactttctttagaaaacaactttattgaggtataatttacataccataaaatccacccatttgaagtacaattcaaagagttgtcgtaagcttaccaccagaatccagttttagaacatctgcatcaccccagtaagacccctcatatgcatctacacttagtgttgagttttgagagttccttatacattctggatacaagtcctttgttggatatataacttacagtattgtcccaatgggggacatttgccaagagttgagaatgctgtaattggaggcctgagaggtgggtcccaattcttacattttccattccacaaactgtctccttttgtttggttttaatatgggtaaacagcacattctggaaataataaaggtgactctccatttgctgaatgccaggaggagagtttatgacagaacttcctcctgcaataaaaggatgtcaaagaagccaacatcaaggtgccccccatccctggtgggtggtcagagagggcaggaggctccagggcaccctgcctggccaatcagtgcacattcttggggttgcagatggtggcggggaaggggacaggttctgcaggggactagggtgggaaccccattgccctctcagattgctccatcagaagagcagatgaggctgcacacagtggctcacgctaaaatatttaacaattatttaatagcatgagatacacaaggcgtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagattagctatccggcatcctcgcaggttctactgtatctttcaccagcttatctcggcaaatccatgccacagaaaaaaacaactgctcacgagctactccatttaccggactaaactgacccatcatcaactagcccttccccggtatcggaaaaggacatgtacacaactgtgcactctaacggtgaaacgcaaggtagggcaaacgcacaaggggcacatgaacaccctgtccacacactgctcccaccacaaagacagacgcgaaaccccacacgcgaacccaaaagacgccgcacccagaccaataacaaacacgacccaaccgcagcagaacgaagcgaaccaccacagcgcaatgaacacaagacaagacccaa

SEQ ID NO: 293736 - DNA, 3263 bp, Homo sapiens
gccgagatcgtgccactgcactccagcctgggtgacagagcgagactctgtcaaaaaaaaaaaagaacaaaagaaagagaaagaaactgtcaaactgttttctggagtggctataccattttgcaatcccaccaaagtatgagagatccagttgttcagcaactggattccaccctggttttaatttgcgtgtccctgatggctagtgatttgaacatcttccacgtgcttttttttttttttttgtcttctgtatacctctttggtgaagagtctgtttaactcttttgctcatttaaaaaattgttcgttttcttaccattgagactttctttagaaaacaactttattgaggtataatttacataccataaaatccacccatttgaagtacaattcaaagagttgtcgtaagcttaccaccagaatccagttttagaacatctgcatcaccccagtaagacccctcatatgcatctacacttagtgttgagttttgagagttccttatacattctggatacaagtcctttgttggatatataacttacagtattgtcccaatgggggacatttgccaagagttgagaatgctgtaattggaggcctgagaggtgggtcccaattcttacattttccattccacaaactgtctccttttgtttggttttaatatgggtaaacagcacattctggaaataataaaggtgactctccatttgctgaatgccaggaggagagtttatgacagaacttcctcctgcaataaaaggatgtcaaagaagccaacatcaaggtgccccccatccctggtgggtggtcagagagggcaggaggctccagggcaccctgcctggccaatcagtgcacattcttggggttgcagatggtggcggggaaggggacaggttctgcaggggactagggtgggaaccccattgccctctcagattgctccatcagaagagcagatgaggctgcacacagtggctcacgctaaaatatttaacaattatttaatagcatgagatacacaaggcgtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 293737 - DNA, 3070 bp, Homo sapiens
gccgagatcgtgccactgcactccagcctgggtgacagagcgagactctgtcaaaaaaaaaaaagaacaaaagaaagagaaagaaactgtcaaactgttttctggagtggctataccattttgcaatcccaccaaagtatgagagatccagttgttcagcaactggattccaccctggttttaatttgcgtgtccctgatggctagtgatttgaacatcttccacgtgcttttttttttttttttgtcttctgtatacctctttggtgaagagtctgtttaactcttttgctcatttaaaaaattgttcgttttcttaccattgagactttctttagaaaacaactttattgaggtataatttacataccataaaatccacccatttgaagtacaattcaaagagttgtcgtaagcttaccaccagaatccagttttagaacatctgcatcaccccagtaagacccctcatatgcatctacacttagtgttgagttttgagagttccttatacattctggatacaagtcctttgttggatatataacttacagtattgtcccaatgggggacatttgccaagagttgagaatgctgtaattggaggcctgagaggtgggtcccaattcttacattttccattccacaaactgtctccttttgtttggttttaatatgggtaaacagcacattctggaaataataaaggtgactctccatttgctgaatgccaggaggagagtttatgacagaacttcctcctgcaataaaaggatgtcaaagaagccaacatcaaggtgccccccatccctggtgggtggtcagagagggcaggaggctccagggcaccctgcctggccaatcagtgcacattcttggggttgcagatggtggcggggaaggggacaggttctgcaggggactagggtgggaaccccattgccctctcagattgctccatcagaagagcagatgaggctgcacacagtggctcacgctaaaatatttaacaattatttaatagcatgagatacacaaggcgtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 293738 - DNA, 2198 bp, Homo sapiens
tcgaggccggtggtaatcggacgaggaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattatactatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactacggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgtccccttaggagcaaaattgcccctggttgagaaacattgctttagacaaattgttaagagtatcatgtactacacttctgaaacttaacgtgatcatcaccactgacagatgattcacagagagagactgtttgaatcttgtctcactagtttttcctgtgcaaaaataaaatggacagaattgca

SEQ ID NO: 293739 - DNA, 1908 bp, Homo sapiens
cggccgctgaccgtgaaaccggtcggcggtggtaccgcttgccgccgcttctccaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattatactatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactacggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgtccccttaggagcaaaattgcccctggttgagaaacattgctttagacaaattgttaagagtatcatgtactacacttctgaaacttaacgtgatcatcaccactgacagatgattcacagagagagactgtttgaatcttgtctcactagtttttcctgtgcaaaaataaaatggacagaattgca

SEQ ID NO: 293740 - DNA, 746 bp, Homo sapiens
ccatccaaagtgtcaagtatattgctgaaaatatgaaagcacaaaatgaagccaaagaggtaaggatatggcttttattacattggtcattcattcattcaacaaatatttatgggttcctcgtggggcaaggcatagggtagggggttaagaaattgccctctggagtcagtggcctgtgttaagaccagttatatgtccttgggtatgttacctcacctctctgagcctgttttctcttctgtaaaatgggatgataaagcttggtatgtggtaccctgaagctagccaccaggctgccagcaggctggcaggctggaccatgaaaacacctgatgccaatagactagattaggatgtaggctggaaaagggcatggggccagatgatctccagttagtattggttaattgaggttatatttttatttttatttatttttttgagacagggtcctgctctgttgcccaggctggagtgcagtggcgcaatcttggctcactgcaacttccgcctcccagctcaagcgattctcccacctcagtttcccgagtagcttgaactacagatgccccgccaccataccctaatttttttgtaccgatggggttttgccatgttgcccaggttggtctcagactcctcgactcaatctgctcacctcagtctcccaaaatgctgggactacaggcatgagccaccgcacctggcctttatttttactttctaattgtatatgtgttctc

SEQ ID NO: 293741 - DNA, 4364 bp, Homo sapiens
gaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgttgctagagggcaaagagttggagttctatcttaggaaaatcaaggccgcaaaggcaaataaatccttgttttgtcttcacccatgtaataaaggtgtttattgttttgttcccaccaaaaaaaaaaaaaaaaaaaaaaaaaaaaaaaaaaaaaaaaaaaaaaaaaaaaaaaaaaaaaaaaaaaaaaaaccaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293742 - DNA, 401 bp, Homo sapiens
tttactttttctgttcaacacatttgtatggaaagaaaataataccttgcacaaactatcaaaattgaactgtagtacgaaaacaatcagcaaaggaatggtagccaccaatacaattctcacggacgcgtgggatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctaccttgcattccatgtttcgtcgac

SEQ ID NO: 293743 - DNA, 561 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattatcgtgataaatatcctgtaaagaaccacctccacaaaactccatgcaaatcc

SEQ ID NO: 293744 - DNA, 267 bp, Homo sapiens
tcatatactactattgtgctaaatattttattttgtactattaggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaaacctgttgccttagggaatggattagctcctccagttaattgggaacgagatgctcatatgtcaca

SEQ ID NO: 293745 - DNA, 4356 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293746 - DNA, 4293 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293747 - DNA, 4250 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293748 - DNA, 4163 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293749 - DNA, 2245 bp, Homo sapiens
ggcagtgatcgagctcggaccagggtgctcggtgtatgtaatgaacaatgctgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293750 - DNA, 2240 bp, Homo sapiens
tgctgggattacaggcaacgtgccatggcacccggcctttttattctaattttaatagatgagctagtatgtcagcaccagttttgaactcatcctttgtgcactgatctataacagtagctttttcatatactaagtttgcctacatatattacgtactcacttttatttacatttaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293751 - DNA, 1752 bp, Homo sapiens
ggttcttgaactgcaaatcgtttttagaacttgtaataagaattaagttcccccaaataatttctaatataggtttctccccacttctgactcttagaagaacactggcctagaggtgggaggtagtggacagcaaaattacttcccagagctagaactggccctgtaatcacagtgatagcaaatgatttctgcccacgatcaaatgagcagcatttatagaggcacatattggagaagcaatggaaaatttgggagctaacattaattttcaggaataactttgttttgttatatgttttttattactttcagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293752 - DNA, 1699 bp, Homo sapiens
ggttcttgaactgcaaatcgtttttagaacttgtaataagaattaagttcccccaaataatttctaatataggtttctccccacttctgactcttagaagaacactggcctagaggtgggaggtagtggacagcaaaattacttcccagagctagaactggccctgtaatcacagtgatagcaaatgatttctgcccacgatcaaatgagcagcatttatagaggcacatattggagaagcaatggaaaatttgggagctaacattaattttcaggaataactttgttttgttatatgttttttattactttcagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatgggtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgttttttaacatgctgttgtata

SEQ ID NO: 293753 - DNA, 2784 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctaccttgcattccatgtttcgtcgac

SEQ ID NO: 293754 - DNA, 2574 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcggccggtgaagccgtattcagggtgggagtggttttgggttttaaaaacacggcgcgt

SEQ ID NO: 293755 - DNA, 1764 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgaggtaggaattgcttttaccagcgggcatatataacatgtatatgtgtatgtatatatgtgtgtctgtatgtacgtctcaaaatccatttttttaattttggggcctagtttaaataaaaaagctcttgagggaacaattaattctttgtctttgcctttcatggaaagtcaaatgctaggtttttcttactgactacttataggtgactatagtgtgaaaatggcaaaggcatatcatttaatccacttgttgaaatcactgtagttatttcaaaatagccattttcggtgaagttgccaaataatcattcactgtaaaagggaaagcaaatgggaagtgcctaaacaagacatttgaatattcaaaatttcccctcagtttgcttctcaaaaagaatcctcagtttggcctggtggctcatgtctgtaatcccatcactttgggaggctgaagcaagaggattacttgaggccaggagtttgaaacctgcctggtcaacatagcaagaccccgtttctatcttt

SEQ ID NO: 293756 - DNA, 651 bp, Homo sapiens
agggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggtatactgtttgtttcccttttgaaaagcaataatgatttcatcacctaatgcattaaacaaaataaagttagttttaatacca

SEQ ID NO: 293757 - DNA, 593 bp, Homo sapiens
gtgtctcttgctaattagcatttcacttctctcatccatgtttgctcagttgattaagaaggcagaggagtataactgaagaagcatcacattgggagacaggagactctgccacaaaggccgggggaccatgggctggtcacccagttcctgggccccaggttccaactctgaaaagagagggttggacacgtgacttataaattcccttccagccttaatgtcctaaaatcatgtaattataactttaaaatattttgcggtggtaaacctaaaatgtttataaaagagagtccataatttagatttttctgcattacctgaatttctgtgacaagatgcagtctttattgtagaaagctgttttatagtattctcatagaattattcggtttttattttccttggtttaatgtatttttgtttctttctctagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcat

SEQ ID NO: 293758 - DNA, 522 bp, Homo sapiens
ggtggatcacgaggtcaggggatcgagaccatcctggctaacatggtgaaaccccgtctctactaaaaatacaaaaaaatcagccgggcgtggtggagggcgcctgtagtcccagctactcgggaggctgaggcagggaaatggtgggaacccagggggtggagattgcagtgagctgagattgcgccactgcactccagcgtgggagacagagcaagactctgcctcaaaaaaaaaaaaaaaaaaaaaaaaaaatcctggttttacttttttttcttttttagttggccaagtgaaatttgatccacccttaagaaaggagacagaaccacatcatgaacttgtaagtagtatagccttagaatgttagcactgaaaataaatgttttaatttgtttttgtgtgatgtattagtactgaccaaaaaagctagtcattaatattttcaaaaacattcgaggtcccagcctggtcaacatagtaagaccctgtctctacaaaaaaatgttaaaacttagttga

SEQ ID NO: 293759 - DNA, 1693 bp, Homo sapiens
ctcccggcagtgcccgagcccggcccgcgggtaccgcccagaaggcgaaggcgccaccaccgccgcagctggccctctggctcccacatccggactcaccggcagctccagccgccgttgcctccgcctccagccgcattgccctcaggcctcgagtcccccactagctccttccgtccaggcacgggctccggcgctagagcagtttgaaaatggcgcggagggacgatcggggccgacacggaggaggcgccgcggttgccccggtaacgggagcggcggacgattagcggctcgcggcggggacgcgcttggcgacgatggcggagccccagtgcccggaaatgcaacggcccggacagcgcgaggccacggcgccccctggaggtcggcgcccgcggccagcaaatgccaaacctcagctggtgcctgagctggcatcctcttcctcctgtcggcgggaggtgtggatcacctactgcgtgcggggaacaaacgccgccccagtaccggtccctgcagcggagtagccttcacctgcaaggtgaacgcctgctcaccacgtaatccccaaacgcagatatcacgttgtctctgcaactttccctgacaaccacccaatgcaattaattatcccacaatagtatctcccgcaggctctctgtagaaccatagaattcatccatcaaaatacaatcatttgttgatccgtctctctctgccgcccccaaatgtgaattccttgagtcagagactattctactcagcaaaacatttgtgagtggaattaaattgaaataaaccgttatagtccactcacagatggaaaacacatagtaaaatcctagaattccatttctcccctgaaaatttcccagacagtcagagggagtttcattctttcctgtttacttttctcccaaataggccttctgaggcagcagaatagggaaggaagtcagaagactgaccagctcatacctatggaatgcctatcatacatacacttaaaattatggcaagctcacgcaggcgcactaagagagaaaaaacaagaaaacagatatgacaattataggaaatcccctccctagagttaaagaagtgtaggaagtgggtataaaagaacaaaggctatattaatccagggctgacaccacttgaagataagcccgttcctctctctggtatattctttgcttaataaattttgtggggtggttatttgtgtgtctcatccaattctttgttcataacaccaagaacctggaactcccaacttccaatctggtaacatattttggtgagccagccaggagggtcaagcctgcaatacctaaagctccagacctggaacccaaagctcccatcagtcgctaccctgtgaacctgtggaggatctgaagtacctgtttaaaaggcatccaaaagatagaatctatcaagctacaaatggctatgttgcctgaagccccagacatcatcctacaagaaataagtccagacttcttaatttccccctggatagagcagggtgatactgtggcctgggtgaagacatcgtatcctctgtgtgtaacagtgataagaaggcttacctcgcagggttattacaagacaaatgaaataactttggcacactattaaaggcttcgtggataattaaagcttcacaaaaaccttaaaaaaattc

SEQ ID NO: 293760 - DNA, 1765 bp, Homo sapiens
ctcccggcagtgcccgagcccggcccgcgggtaccgcccagaaggcgaaggcgccaccaccgccgcagctggccctctggctcccacatccggactcaccggcagctccagccgccgttgcctccgcctccagccgcattgccctcaggcctcgagtcccccactagctccttccgtccaggcacgggctccggcgctagagcagtttgaaaatggcgcggagggacgatcggggccgacacggaggaggcgccgcggttgccccggtaacgggagcggcggacgattagcggctcgcggcggggacgcgcttggcgacgatggcggagccccagtgcccggaaatgcaacggcccggacagcgcgaggccacggcgccccctggaggtcggcgcccgcggccagcaaatgccaaacctcagctggtgcctgagctggcatcctcttcctcctgtcggcgggaggtgtggatcacctactgcgtgcggggaacaaacgccgccccagtaccggtccctgcagcggagtagccttcacctgcaaggtgaacgcctgctcaccacgtaatccccaaacgcagatatcacgttgtctctgcaactttccctgacaaccacccaatgcaattaattatcccacaatagtatctcccgcaggctctctgtagaaccatagaattcatccatcaaaatacaatcatttgttgatccgtctctctctgccgcccccaaatgtgaattccttgagtcagagactattctactcagcaaaacatttgtgagtggaattaaattgaaataaaccgttatagtccactcacagatggaaaacacatagtaaaatcctagaattccatttctcccctgaaaatttcccagacagtcagagggagtttcattctttcctgtttacttttctcccaaataggccttctgaggcagcagaatagggaaggaagtcagaagactgaccagctcatacctatggaatgcctatcatacatacacttaaaattatggcaagctcacgcaggcgcactaagagagaaaaaacaagaaaacagatatgacaattataggaaatcccctccctagagttaaagaagtgtaggaagtgggtataaaagaacaaaggctatattaatccagggctgacaccacttgaagataagcccgttcctctctctggtatattctttgcttaataaattttgtggggtggttatttgtgtgtctcatccaattctttgttcataacaccaagaacctggaactcccaacttccaatctggtaacatattttggtgagccagccaggagggtcaagcctgcaatacctaaagctccagacctggaacccaaagctcccatcagtcgctaccctgtgaacctgtggaggatctgaagtacctgtttaaaaggcatccaaaagatagaatctatcaagctacaaatggctatgttgcctgaagccccagacatcatcctacaagaaataagtccagacttcttaatttccccctggatagagcaggattcgattcagttggaaagacatggttaatgcttaagagagccagaagaacccaaatctttgaacacacttagagcaaccacaaactgctgttagaaaactaatgttaatgtttaagaagtacttgttattttagtttaccttatcaaatttggtcctgtcagcaacatcgagatcagaggcagacatgtttcccatatccaacagggaagatgactgagatctgcgattc

SEQ ID NO: 293761 - DNA, 275 bp, Homo sapiens
ctacagtggtagcagtggtggaagccatggattgtagcagtagtgatgtcatcttgaagccaaaagttcagtgatggccctttgacttctggccctccagcacttccactgattttgtgatactgtggcctgggtgaagacatcgtatcctctgtgtgtaacagtgataagaaggcttacctcgcagggttattacaagacaaatgaaataactttggcacactattaaaggcttcgtggataattaaagcttcacaaaaaccttaaaaaaattc

SEQ ID NO: 293762 - DNA, 2189 bp, Homo sapiens
ctcccggcagtgcccgagcccggcccgcgggtaccgcccagaaggcgaaggcgccaccaccgccgcagctggccctctggctcccacatccggactcaccggcagctccagccgccgttgcctccgcctccagccgcattgccctcaggcctcgagtcccccactagctccttccgtccaggcacgggctccggcgctagagcagtttgaaaatggcgcggagggacgatcggggccgacacggaggaggcgccgcggttgccccggtaacgggagcggcggacgattagcggctcgcggcggggacgcgcttggcgacgatggcggagccccagtgcccggaaatgcaacggcccggacagcgcgaggccacggcgccccctggaggtcggcgcccgcggccagcaaatgccaaacctcagctggtgcctgagctggcatcctcttcctcctgtcggcgggaggtgtggatcacctactgcgtgcggggaacaaacgccgccccagtaccggtccctgcagcggagtagccttcacctgcaaggtgaacgcctgctcaccacgtaatccccaaacgcagatatcacgttgtctctgcaactttccctgacaaccacccaatgcaattaattatcccacaatagtatctcccgcaggctctctgtagaaccatagaattcatccatcaaaatacaatcatttgttgatccgtctctctctgccgcccccaaatgtgaattccttgagtcagagactattctactcagcaaaacatttgtgagtggaattaaattgaaataaaccgttatagtccactcacagatggaaaacacatagtaaaatcctagaattccatttctcccctgaaaatttcccagacagtcagagggagtttcattctttcctgtttacttttctcccaaataggccttctgaggcagcagaatagggaaggaagtcagaagactgaccagctcatacctatggaatgcctatcatacatacacttaaaattatggcaagctcacgcaggcgcactaagagagaaaaaacaagaaaacagatatgacaattataggaaatcccctccctagagttaaagaagtgtaggaagtgggtataaaagaacaaaggctatattaatccagggctgacaccacttgaagataagcccgttcctctctctggtatattctttgcttaataaattttgtggggtggttatttgtgtgtctcatccaattctttgttcataacaccaagaacctggaactcccaacttccaatctggtaacatattttggtgagccagccaggagggtcaagcctgcaatacctaaagctccagacctggaacccaaagctcccatcagtcgctaccctgtgaacctgtggaggatctgaagtacctgtttaaaaggcatccaaaagatagaatctatcaagctacaaatggctatgttgcctgaagccccagacatcatcctacaagaaataagtccagacttcttaatttccccctggatagagcaggggtactccttaatgactttacgaagttcttgtttgttaaatgcaagttggtaacttacttcctcctcccttatgccctgtgccacgcgagcttcaacaccttcaaagaaatgcttcaaggaaatgaaaagaaacaatggctaagacctgcatttattattatttacattaaaaaaatctgattacaaagtagtgtataatcaccatgcaaaaatcagtgtgtgaaagtatagacaataaaataacaatcacttattaacatacttctgagatgaacattgttaatattgtagagttccttgtaatcttttgatgtgtgaatacatacaggagattaaaatttcatgtcccactttacatgtaatactgttttttcctaaatataaattttaatggctgcataatatttcacacaatgtctgaaccacaattattattcattcctctagtactagatatttaacatcccactcccccttctttttttggacttggcaaatctagtgagactttagaaaatctactataaatatatttgtcatagcagggacccactcgggtccctgcactggtaaggagatggagctcgaccaccatccattgtgatgagtcctgcggctgatcctgacccacatggagtccatgttgcaccacct

SEQ ID NO: 293763 - DNA, 624 bp, Homo sapiens
agacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaaata

SEQ ID NO: 293764 - DNA, 424 bp, Homo sapiens
gatgccacagaacccatgcagcagcctcaaggtagggcccactggggtcctggatttcagtttctcctctgtaaagtgagtatgttgtgcccggagaggagacccccagctccagctggctcaaccacatccaccatgctgtgtgactccagatgcatcacaggctgtctctggcccagccccagacagcgggagaagaaagctcaggagtccgtggaaactgcagggacaccgcccctcgtgccctggaagaggctccacagtccacccccagccctccagcttgagttccaccttcgactccactcatgatcacacagggctgggctctctccacgtcccctgcatcgcccaggatggcccagtctccgaggacatccatgtatgcaaaataaaatccctctgctaggcgtgccctgcaaaa

SEQ ID NO: 293765 - DNA, 3780 bp, Homo sapiens
ctcctacttggcgcgccactgtggttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttcccccccttcctcttcccctgggcaatttaccgatgtactgatgacttgtaaatccacgtctccaaaccagacaacatccataaccacagatcagcatattaagaactaatccattttgtccttttagtgttttcatttaaaaagttaaattcacaaacaacagatatattgtactttttttttttttaagttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatatgggaatgccacaagggaatggcccaagacgtcataagtaccatagggcaggcttttgaactccggtttaaacagtacttgaaaaatccttctttgaatacttctggtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactggccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcactggactgtcccatttgctggttaaaaggattggggcccaaatcctctggcctagcatttctcagtgtttgctattcagactgtctaaatacagcatgtgacaagctgaagaagccaaatctagcagtcatttctgatttcattatattctccccctcttcctgctaaaaagacaaaaaacaaaaaacaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggattggttgagtagcagaaaactacttatgtccttttcttgcctttccaagaaaaatgttttttgttttttttaaatcttgagttatctggatattgccttgactccatttcatttgggctatgtagatacaacttagtcttggtgatggtgatatattggctaagttttaaataaaacttctttgggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgacagaatatgtctgatgt

SEQ ID NO: 293766 - DNA, 3494 bp, Homo sapiens
ctcctacttggcgcgccactgtggttggagtagctcagtgttttctccggggtgttggcgtcgccttttgagctacgtttccatcgattcgaacttcgtatctagggaccctgcatgcaagagcttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatatgggaatgccacaagggaatggcccaagacgtcataagtaccatagggcaggcttttgaactccggtttaaacagtacttgaaaaatccttctttgaatacttctggtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactggccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcactggactgtcccatttgctggttaaaaggattggggcccaaatcctctggcctagcatttctcagtgtttgctattcagactgtctaaatacagcatgtgacaagctgaagaagccaaatctagcagtcatttctgatttcattatattctccccctcttcctgctaaaaagacaaaaaacaaaaaacaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggattggttgagtagcagaaaactacttatgtccttttcttgcctttccaagaaaaatgttttttgttttttttaaatcttgagttatctggatattgccttgactccatttcatttgggctatgtagatacaacttagtcttggtgatggtgatatattggctaagttttaaataaaacttctttgggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgacagaatatgtctgatgt

SEQ ID NO: 293767 - DNA, 4800 bp, Homo sapiens
ctcctacttggcgcgccactgtggttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttcccccccttcctcttcccctgggcaatttaccgatgtactgatgacttgtaaatccacgtctccaaaccagacaacatccataaccacagatcagcatattaagaactaatccattttgtccttttagtgttttcatttaaaaagttaaattcacaaacaacagatatattgtactttttttttttttaagttatagtgaagaaatacttggtcccatttcttttcgcctgggaggtatctttccactattagcaatgcggtgtgtattctttgaattctttttatttgcatttacatgtatctttatgtattgacagcaaaatactattttgtgtgttttttaaaaacatgttttacctgtttttaccttcaacttaaaagcctcaggttttaagttgtatatacttatatgaattatatgactgtgtatacttacaggattcaagcacatttcatttattctgcactttatttctattattattacattatagttatgtagaattatacaactcaccataatgtagaatcaatgggagccctgagcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgatactacagactatgttgcctacgtagctaaagatccagttaatcaacgagcctgtcacatatgggaatgccacaagggaatggcccaagacgtcataagtaccatagggcaggcttttgaactccggtttaaacagtacttgaaaaatccttctttgaatacttctggtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactggccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcactggactgtcccatttgctggttaaaaggattggggcccaaatcctctggcctagcatttctcagtgtttgctattcagactgtctaaatacagcatgtgacaagctgaagaagccaaatctagcagtcatttctgatttcattatattctccccctcttcctgctaaaaagacaaaaaacaaaaaacaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggattggttgagtagcagaaaactacttatgtccttttcttgcctttccaagaaaaatgttttttgttttttttaaatcttgagttatctggatattgccttgactccatttcatttgggctatgtagatacaacttagtcttggtgatggtgatatattggctaagttttaaataaaacttctttgggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgacagaatatgtctgatgt

SEQ ID NO: 293768 - DNA, 1621 bp, Homo sapiens
ctcctacttggcgcgccactgtggttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttcccccccttcctcttcccctgggcaatttaccgatgtactgatgacttgtaaatccacgtctccaaaccagacaacatccataaccacagatcagcatattaagaactaatccattttgtccttttagtgttttcatttaaaaagttaaattcacaaacaacagatatattgtactttttttttttttaagttatagtgaagaaatacttggtcccatttcttttcgcctgggaggtatctttccactattagcaatgcggtgtgtattctttgaattctttttatttgcatttacatgtatctttatgtattgacagcaaaatactattttgtgtgttttttaaaaacatgttttacctgtttttaccttcaacttaaaagcctcaggttttaagttgtatatacttatatgaattatatgactgtgtatacttacaggattcaagcacatttcatttattctgcactttatttctattattattacattatagttatgtagaattatacaactcaccataatgtagaatcaatgggagccctgagcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgtaagtatggattcacagaagttctttttatgagttaaaataacttcttgacatttggggctggatga

SEQ ID NO: 293769 - DNA, 300 bp, Homo sapiens
ttggcttaccccgttttgtctacagaaagctaaacaactcaaccatctgactgctcccatccaaatgtttaacatcacttaagcacagctataaactgaaaacatgaatgcaaagtttttcaggatgatttgcttggttctgatccccttgcatcccttacagtatttgaattttcgcccagcctcttgaggattcttttttccttcacagtgaggaggtgcatattgatagccatgccgaggagagagaagatcatgaatattacaatgaaattccagggaagcagccaccagtaggtg

SEQ ID NO: 293770 - DNA, 1922 bp, Homo sapiens
cgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctggataaggaacctaattcgagctacccttctctgtgaagctcgacggctgagaacgtcagggctcgttcccaagtctctttccagaggccaggctttatgggagcatgggttaccagcgacgcaccctgatcaagcagagaaagagaggctggagaaggaagagtgacagaagtaagaagagagtgtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtgaggatgcagtgtccaaggcaccatcttgaactcatcatcgccaaatatgtgagcaccttgatgttggacttcccaacctccagaccgtaaggcagtacatttctttgtaaattacgcagtctcagctattctgttacagcagcacaaatggactaagacaacccccgagataggaaggggtaaggtaaatgcaatgagagttggggttttcgatcttagtccagtaaaggagctggaactgttctgtataaacaaagggcaaggtaattgctacatagattcttttcttattattgctgattcttatcctaaaataaaggacattgccactacacatcctctagaatgaccaaaaataaaaatacagcatcaaatgggacgacatggtgccaactggaattctcataccctgctgatgggagtataatgtggtacagtcactttggaaaaaagtttgacaatttcttataaaattatacataaacctgtactatgacctagagattctactcctgtttgttcaaaagaaaggcaaacatctgtccactaaaagatatgtacaagaatgctcacagtggcattatttatgacggtccaaaccaggagataatccaaatgtctgtaaccaagagaatggataaagaaattttgatacgtcaatttaatggattactacttagcaataaaaataattagccatgctgggcgcggtggcttatgcctgtaatcccagcactttgggaggctgaggcaggtggatcacctgaggttgggagttcaagaccagcctgaccaacatggagaacccccgtctctactaaaatacaaaattagccggggtggtggcgcatgcctgtaatcccagctactcgggaggctgaggcaggagaatcacttgaacccgggaggtggaggttgcattgagccgagattgcgccattgcactccagcatgggcaaaaagagcaaaactccgtctcaaaaaaaataaataaataataattagccacatatccacacaacaatattgcattatcacaggtatagtgataaatactgtatgattccatttatatgaagttcaagaacaggcaagtaatccatgatgaaagaagtacttacctctgggggtggcagcattgactaaagaggtacaagggagtcttctggggcctggaaatgttctatatcttgatctgggtggtggttacacaggtatacgcgtgttaagaaatcatcaggctgtatacttagtgtactgtaatggcattacactgtctttcaattaaaatgtgaaagaaaaaacgggggtgtctttt

SEQ ID NO: 293771 - DNA, 857 bp, Homo sapiens
cgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctggataaggaacctaattcgagctacccttctctgtgaagctcgacggctgagaacgtcagggctcgttcccaagtctctttccagaggccaggctttatgggagcatgggttaccagcgacgcaccctgatcaagcagagaaagagaggctggagaaggaagagtgacagaagtaagaagagagtgtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtaagtccattcctgcttcagggcctttgtacgtattgtttcctcttcctggaatcttcttccttgtacagccccagggttttctttttttcatccagatcacagcacagatgtcacatcctggtaacagccagctgtgactcatctccctaattctcaattgtattactctctttttattttcttcgtatcgtaactgatagtctcatacagtacagaagccaagttttaagatatgcaatcaccaaatacctgc

SEQ ID NO: 293772 - DNA, 961 bp, Homo sapiens
  misc_feature (915)..(915): n is a, c, g, or t
  misc_feature (925)..(925): n is a, c, g, or t
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtactccaggaacgtctctatcaagaatacaatttcagcaaggctgagggccatctgaacagatggggaagatattttcccgaatcaaagcagggtggtaatggcccttgaaggggggctccngagaaagatnaaaaacagaaaaacggtctcgaaataggggccgata

SEQ ID NO: 293773 - DNA, 1341 bp, Homo sapiens
  misc_feature (1076)..(1076): n is a, c, g, or t
  misc_feature (1093)..(1093): n is a, c, g, or t
  misc_feature (1128)..(1128): n is a, c, g, or t
  misc_feature (1153)..(1153): n is a, c, g, or t
  misc_feature (1186)..(1186): n is a, c, g, or t
  misc_feature (1228)..(1228): n is a, c, g, or t
  misc_feature (1236)..(1236): n is a, c, g, or t
  misc_feature (1238)..(1239): n is a, c, g, or t
  misc_feature (1243)..(1243): n is a, c, g, or t
  misc_feature (1258)..(1258): n is a, c, g, or t
  misc_feature (1261)..(1261): n is a, c, g, or t
  misc_feature (1275)..(1275): n is a, c, g, or t
  misc_feature (1279)..(1280): n is a, c, g, or t
  misc_feature (1285)..(1285): n is a, c, g, or t
  misc_feature (1295)..(1295): n is a, c, g, or t
  misc_feature (1301)..(1301): n is a, c, g, or t
  misc_feature (1311)..(1312): n is a, c, g, or t
  misc_feature (1316)..(1316): n is a, c, g, or t
  misc_feature (1319)..(1319): n is a, c, g, or t
  misc_feature (1321)..(1322): n is a, c, g, or t
  misc_feature (1326)..(1326): n is a, c, g, or t
  misc_feature (1332)..(1332): n is a, c, g, or t
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctggggtctttcacagagcagagatttttaagtttaatgaagtcctgcttatcaattttctctttcacggattatacctttggtgtattttgtcactgccaaatccaagatcacctggattttaccctatgttatcttctgggagtttcatagntttgcattttatgtttnaagtctgtgaaccattttgagtttatttttgtggnccagaggctgttcttagttacttgnctcttgggcctttctgacatgactgcttgcttnctcgcagcaagggagtgtgctcctagtaagacagaccttatngcctaggnanntacntatgaagggcacctngcncatttctgggattntagnnccagncctgccacgncggggntaggagtacnngggngtntnncagngacatnttggggtgg

SEQ ID NO: 293774 - DNA, 994 bp, Homo sapiens
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacagtcgtctaatcacagacatacgaactcttcaagcgaaggggctgaagggccatctgaaacacgatggagaagatatatactcagcaaatacaaagcaaaggatgtagacattgaacctgctatgaaaaggggaagggttaccatcccatgcacgaaaagtagctaggacagaactacaaaggaatcag

SEQ ID NO: 293775 - DNA, 1522 bp, Homo sapiens
  misc_feature (1257)..(1257): n is a, c, g, or t
  misc_feature (1274)..(1274): n is a, c, g, or t
  misc_feature (1309)..(1309): n is a, c, g, or t
  misc_feature (1334)..(1334): n is a, c, g, or t
  misc_feature (1367)..(1367): n is a, c, g, or t
  misc_feature (1409)..(1409): n is a, c, g, or t
  misc_feature (1417)..(1417): n is a, c, g, or t
  misc_feature (1419)..(1420): n is a, c, g, or t
  misc_feature (1424)..(1424): n is a, c, g, or t
  misc_feature (1439)..(1439): n is a, c, g, or t
  misc_feature (1442)..(1442): n is a, c, g, or t
  misc_feature (1456)..(1456): n is a, c, g, or t
  misc_feature (1460)..(1461): n is a, c, g, or t
  misc_feature (1466)..(1466): n is a, c, g, or t
  misc_feature (1476)..(1476): n is a, c, g, or t
  misc_feature (1482)..(1482): n is a, c, g, or t
  misc_feature (1492)..(1493): n is a, c, g, or t
  misc_feature (1497)..(1497): n is a, c, g, or t
  misc_feature (1500)..(1500): n is a, c, g, or t
  misc_feature (1502)..(1503): n is a, c, g, or t
  misc_feature (1507)..(1507): n is a, c, g, or t
  misc_feature (1513)..(1513): n is a, c, g, or t
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgccggagctgcggcccgcaactccctcagcctggcaggtcccaggatgcttcggggcaaccccacgcatgcgcgctctggcgtagttccctgaagcactcgctcgcagagaatcctggaatcttcgcttgtggagctgtggaggcaacggagtttttccgcgctttttctttcagcctcagagactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctggggtctttcacagagcagagatttttaagtttaatgaagtcctgcttatcaattttctctttcacggattatacctttggtgtattttgtcactgccaaatccaagatcacctggattttaccctatgttatcttctgggagtttcatagntttgcattttatgtttnaagtctgtgaaccattttgagtttatttttgtggnccagaggctgttcttagttacttgnctcttgggcctttctgacatgactgcttgcttnctcgcagcaagggagtgtgctcctagtaagacagaccttatngcctaggnanntacntatgaagggcacctngcncatttctgggattntagnnccagncctgccacgncggggntaggagtacnngggngtntnncagngacatnttggggtgg

SEQ ID NO: 293776 - DNA, 714 bp, Homo sapiens
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgacggagggtcgctcttgttgccgtggctggagtgcaatggtgcgatctcggctcactgcaacctttgcctcgtgggttcaagtgattctcctgcctcagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaaaaaaaaaaa

SEQ ID NO: 293777 - DNA, 1140 bp, Homo sapiens
  misc_feature (875)..(875): n is a, c, g, or t
  misc_feature (892)..(892): n is a, c, g, or t
  misc_feature (927)..(927): n is a, c, g, or t
  misc_feature (952)..(952): n is a, c, g, or t
  misc_feature (985)..(985): n is a, c, g, or t
  misc_feature (1027)..(1027): n is a, c, g, or t
  misc_feature (1035)..(1035): n is a, c, g, or t
  misc_feature (1037)..(1038): n is a, c, g, or t
  misc_feature (1042)..(1042): n is a, c, g, or t
  misc_feature (1057)..(1057): n is a, c, g, or t
  misc_feature (1060)..(1060): n is a, c, g, or t
  misc_feature (1074)..(1074): n is a, c, g, or t
  misc_feature (1078)..(1079): n is a, c, g, or t
  misc_feature (1084)..(1084): n is a, c, g, or t
  misc_feature (1094)..(1094): n is a, c, g, or t
  misc_feature (1100)..(1100): n is a, c, g, or t
  misc_feature (1110)..(1111): n is a, c, g, or t
  misc_feature (1115)..(1115): n is a, c, g, or t
  misc_feature (1118)..(1118): n is a, c, g, or t
  misc_feature (1120)..(1121): n is a, c, g, or t
  misc_feature (1125)..(1125): n is a, c, g, or t
  misc_feature (1131)..(1131): n is a, c, g, or t
agctcggtaccctcataggttcgcagggatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctggggtctttcacagagcagagatttttaagtttaatgaagtcctgcttatcaattttctctttcacggattatacctttggtgtattttgtcactgccaaatccaagatcacctggattttaccctatgttatcttctgggagtttcatagntttgcattttatgtttnaagtctgtgaaccattttgagtttatttttgtggnccagaggctgttcttagttacttgnctcttgggcctttctgacatgactgcttgcttnctcgcagcaagggagtgtgctcctagtaagacagaccttatngcctaggnanntacntatgaagggcacctngcncatttctgggattntagnnccagncctgccacgncggggntaggagtacnngggngtntnncagngacatnttggggtgg

SEQ ID NO: 293778 - DNA, 1288 bp, Homo sapiens
  misc_feature (1023)..(1023): n is a, c, g, or t
  misc_feature (1040)..(1040): n is a, c, g, or t
  misc_feature (1075)..(1075): n is a, c, g, or t
  misc_feature (1100)..(1100): n is a, c, g, or t
  misc_feature (1133)..(1133): n is a, c, g, or t
  misc_feature (1175)..(1175): n is a, c, g, or t
  misc_feature (1183)..(1183): n is a, c, g, or t
  misc_feature (1185)..(1186): n is a, c, g, or t
  misc_feature (1190)..(1190): n is a, c, g, or t
  misc_feature (1205)..(1205): n is a, c, g, or t
  misc_feature (1208)..(1208): n is a, c, g, or t
  misc_feature (1222)..(1222): n is a, c, g, or t
  misc_feature (1226)..(1227): n is a, c, g, or t
  misc_feature (1232)..(1232): n is a, c, g, or t
  misc_feature (1242)..(1242): n is a, c, g, or t
  misc_feature (1248)..(1248): n is a, c, g, or t
  misc_feature (1258)..(1259): n is a, c, g, or t
  misc_feature (1263)..(1263): n is a, c, g, or t
  misc_feature (1266)..(1266): n is a, c, g, or t
  misc_feature (1268)..(1269): n is a, c, g, or t
  misc_feature (1273)..(1273): n is a, c, g, or t
  misc_feature (1279)..(1279): n is a, c, g, or t
gaagacacttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctggggtctttcacagagcagagatttttaagtttaatgaagtcctgcttatcaattttctctttcacggattatacctttggtgtattttgtcactgccaaatccaagatcacctggattttaccctatgttatcttctgggagtttcatagntttgcattttatgtttnaagtctgtgaaccattttgagtttatttttgtggnccagaggctgttcttagttacttgnctcttgggcctttctgacatgactgcttgcttnctcgcagcaagggagtgtgctcctagtaagacagaccttatngcctaggnanntacntatgaagggcacctngcncatttctgggattntagnnccagncctgccacgncggggntaggagtacnngggngtntnncagngacatnttggggtgg

SEQ ID NO: 293779 - DNA, 772 bp, Homo sapiens
gtgagtgtgcgcttaattttgctctctaattgttttgaatttctcttccatttgagttatatacccaggtggcaggcctttatttcaagtcggcataggagtgtgtgtgagtcgcaaggagattaatttcggctgtgtggaggttgggagaaggcagtgaaatgctcttcctggcttgtttccacgtgggcctctgcagtactgggtttgccttccgtctccgagtcctggtgacccaggaacaatagactgtgcttcatgtgcacagtgcgtgtgttcttggaaaacgccggcttcattttgcttggcgggaaagatattatcatcctaatgctgttttgatttatatctccctgggtgaggtcagatttcgggagaaggcgttcagctcagtagagtttaattctccggtgagtgtctagagggcccaggtccttactgggtttgtggaagctgcagcgtaccttgtctttctcctggccttcgctcagatcatttcggctttcttggtgaacctgggcagcaaactctgaagacagataagccttaaaaggagctcctaatttttaatgttgccactgtggtgattgtgtccttaaaagctatggaaaaagattagggaccttagttcagggcaagcctctagatttaaattccagcgccacagtttacagctctggtgaccttgggagaagcagtgagccattccgaggcttagctttccaagatcagataaaatatataaaaactaggctctagttggtgtgtaata

SEQ ID NO: 293780 - DNA, 440 bp, Homo sapiens
aatgcatgtttgtaatgcagactcaaggaaaattataatttccttaaatgtgtatagaggatgtgtgagagtggaaagatgtctattccaaggtggataaaaaataaaatggtggactacctcaacatggaggtgccagctgtccaattacagctgtcactctgtttctgggaatttctcccgattcttagccggagctgcggcccgcaactccctcagcctggcaggtcccaggatgcttcggggcaaccccacgcatgcgcgctctggcgtagttccctgaagcactcgctcgcagagaatcctggaatcttcgcttgtggagctgtggaggcaacggagtttttccgcgctttttctttcagcctcagattaagtatcatttgttactattattttctctactgagcgtggaaagctggctgaaaattccagagtgt

SEQ ID NO: 293781 - DNA, 4393 bp, Homo sapiens
  misc_feature (1041)..(1041): n is a, c, g, or t
  misc_feature (1382)..(1382): n is a, c, g, or t
  misc_feature (1548)..(1548): n is a, c, g, or t
  misc_feature (2914)..(2914): n is a, c, g, or t
  misc_feature (3164)..(3164): n is a, c, g, or t
  misc_feature (4034)..(4034): n is a, c, g, or t
cccaggagttctgggcgagctgcagcctaggggcctggaaggccaggaagacttgaaggatctgtgttggtaggcctggagtttggctaacgtggggatgatttggattctgagatgcagatacattgcctttttggtatccaatttgaaaagtagcaaccattttgctatcccaaagaacatccatggaggctttcaacaaataatatgctcacctgtttcagggaattatctatatcccttaagtggattttcgatcttgtgtttctgagggcaagcagttaagaagggaagatgaacataaagtagggaagagcaaaaatgagttggaacctaagacacgagctggtcattctttcactgtctccaactttaaagatatgagtatccttgctagaggagctgacactttttgccacaggactagacacacacacagctcaggaatcaaaaaaggtgaaggaagactcagggaaaagcttctgccccatcccaacaaggtgaaccagctgattggtgacaaagtagatgagccgcagtagcacctagtgtccctgcaccaccgtttcaagtataaaactggagggatgcttcagttctccccttcaagacttacacaaccatgtctctgttgggctattctaaccagaaacaaaaggaaaggaaattctgggaaacatagtttagcttagcaaagttgatatattacaaaattaccactgtccactctgcatcgagttgacatccatacagacctctttaaaacacactttcaaaataaagtccacaccctacacataagctatctctagagaaatttgaagtctgttgtgcactgaggataaccacaacaacaaactgtaaacctagcccaatttctgactagactgataccaccgaaccactgctatgcactcaagagcactaaaggcctagcagaaggaaagacacactcatctccaagcataaaaacaatctttacttcatactgtgaagagagaattgaaaaaataatttaagcaaaaaaaatacaacatgacnaacttttaacagaaagaaaaaaagacgcatacagaaaggcaagaaaaaacacagtccaaagagataaaacaatcattagaaccagattcataagacatagacattagaaatatgagagaattttaaataactgtgattaatgtgatgaaggccctaaggggaaaggtgaacaaaatgcaagctcagatgggtgattttagcaaatagatggaaactatcaggaaaaataaaatggaaactataaaaataaaaaatataataatagagatgaagaatgccctccatgggcccattaggagactgaacacagttgaggaaaaaatcagacttgaaggtaggtnaatagaaattgctgaaacacacacacacacacacacaaaaagagtgacagaaacagaacacagcatccaagactggtgggaaaatatcaacatcaaatcaagaaataggcgcagtggctcacccctgtaatcccagcacttggggaggccgaggcaggcagatcangaggtcaggagatcgagaccatcctagctaacgcagtgaaaccccgtctctactaaaaattcaaaaaaattagccgggcatggtagcaggcacctgtcgtcccagctactcgggaggctgaggtaagagaattgcgtgaacccgggaggcggagcttgcagtgagctgagatcacaccactgcactccagcctgggcgacagagcaagactctatctcaaaaaaaaaaaaaaaatcaagaaataatggctgagaatttccaaaatttgtaagacaccaaaccaatccaaggagctcagagaacacagagcaggataaattctttaaaaagaaactaagcttattgtattcaaactaagcttattgtattgatacctggtagttataacttaccaaatacactgcccaacatctccagatgatctattatttctgaaagtttcctttattacatttcttacttcagggagatatagccttcgcttcatgttatggttggtgcagtcagtattctcagaaagaaagtactggttccattttacctccatcttttgtttcctgtcagaaaacctaccataccaccaagtactccttctctacactgcctctgatatttaagtaatttgagaattctgttgagactatctcccttttttggtatgatgaatctggtcctaaattgcatgccaaagactttgagaactaaactgtagacccagatctcatgtcccagactggccttttgttacccacacaatgaatgggttaaattgcttggcaggggacagtccaatgaccacaaccaaggaggatttcccagggggattttattacttgcgataagtaaggaggacactgggaataattccccaaagcaatgcctccctgagcaatggtgcaaacatggcttttattagtctggttagctgagtcattgtatgtagaggtggagtcaaggcagcgcagtcccagttgtcggttatgctgctacatatgtcacatgtatagaaaatggtgaataagctcctccttggacaggattttaagtatggtgatgaggaaagttggccaaagttcatctccaactcaggcatctctgggtccaactggtctttgtttttcctgggctaagcttcttcctggaactttttaaaacaaaaattcaagatgtaacagttacaagtgtgtaactttttcacagtgcgtacccaaaacccaaggaccctgggttacactttaggtgccacccatgtgggacctatcagaagagtactacaaaggctttgaaaactgaactgacattggaaccacaaccctcagaaggctggtcaaaacttatgacttgaacccaaatgggttaattaccntttaaaacataaatatcaacatcctccaccaaatttaaccaagacccagagcatcctaatgacattcaaaatgtccaggatacaatcgatattaattggcaggtgaagaaccaggaaaatctcaactcacgttgggaaaaaatgtaacagatgcagaatgtaagttgccacacatgttggaattatcaagactataaagctgctattcaaatggaaagtttaaaagtctcagagaagtaatagaaaatanaaagaatagccccatggaaattttagaacgggaaaatacaaaaaccgtcatcacatcatatccggggcacatgctgtcaacattgctcatcactgttgatgttaaccttgatcacccggctgaggtagtatttgatgggtttctccctgtaaagttattctttcccctccccctattttactgtttagtgggaagtcactatgtgcagcccatgcctaaaaagggagtagttggtgggcacggtggctcacgcctgtaatcccagcactttgggaggctgagtgggtggatcacctgaggtcaggagttcgagaccagcttggccgacatggtgaaaccccgtctctgctaaaaatacaaaaattagccaggcatggtggtgcacgcctgtaatcccagctattcaggaggctgaggcaggagaactgcttgaacctgggaggcagagattgcagtgatcctgccattgcactccagcctgggcgatgagcaaaattccatctcaaaagaaaaaaaagtgagtagttatatttcccctccttgcggtggagtatctacattcttctgcatgagaaatttgtcagttatctcctatttattcaattatttatattatgaattcatggattcctattttatactttgggtataatccaatactatgttgtttattttactgctcagattattcctgtgttggccattgggaactttttcagttgacatctgtgtccctttgacaaactcctgtcattttgtggggaagagggagtagcactttcttactttctaccgctacaaaatcctccagtcttatcttgtatttctcttccctaaccctaaagtcaatcattctcatttctctaatgntaaatgatgttaaacatcttttcatatgctttcttattatctgtatatcttctctgatgattaccaaggatgggaagggtagtagggggaaagtggagatggttaatgggtacaaaaaatagaatgaataagaattagtagttgatagcacaacagggtgattacagtcaaaaataattgtacattataaaataactagtataattggattatttataacaaaggctgaaggcttgaggtgataaataccccatttaccctgatgtgactattacacattgcatacctgtatcaaaataccttgtataccccataaatatataacctactatgtacccatttaaataaaaaaagttttt

SEQ ID NO: 293782 - DNA, 1259 bp, Homo sapiens
cggccttcctgtacagcgacggccagtccgagaccatccttggcggcctggggctccgaatgggcagcagcgactgcagagtgaaaattgctaccaaggccaatccatggattgggaactccctgaagcctgacagtgtccgatcccagctggagacgtcactgaagcggctgcagtgtccctgagtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagcttctggaaggagcaccacttcgagggcattgccctggtggagaaggccctgcaggccgcgtatggcgccagcgctcccagcatgacctcggccgccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttgcccacgaatgtcccaactacttcatctaagctcattgtggctcaggctgcccaaggcttttctgtcaactcttttgctctctcccgctttgtctaatttagaactgcctcactaaattcttagggatggaagtatttggaaaaaaacctaacagtagagtcaccacctaaggaagaataaaatctcccagggtgctgtgtgttagtctgtttgcgttgctataaaagaatacctgagactgggtcatgtataaagaaaagaggtttctttggctcacagttctgcagtctgtacaagagggtgtggtgccggcatctgctcttggtgagggcctcaggaagcttagaatcatggcagaaggggaaacggagccagcgtgtcacatggtgagagagggagcaagagacagacaggggaggaaattcacacactgatggtggggatgtaaaatggtacaaccagtttggaaaacagtttggcagtttctcaaaggattaaacataaaattaccataggattcagcagttccacttgtgggtatgtagcccagagaaatgaaaacatatctccccaccttgggtatgagatttcacattatcattgctcataatagcccgtaagt

SEQ ID NO: 293783 - DNA, 4969 bp, Homo sapiens
cgcgcacccggagaaacagttttatacagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataaaaaaaaaa

SEQ ID NO: 293784 - DNA, 4915 bp, Homo sapiens
cgcgcacccggagaaacagttttatacagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataaaaaaaaaa

SEQ ID NO: 293785 - DNA, 4013 bp, Homo sapiens
cgcgcacccggagaaacagttttatacagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagtta

SEQ ID NO: 293786 - DNA, 866 bp, Homo sapiens
  misc_feature (8)..(8): n is a, c, g, or t
  misc_feature (46)..(46): n is a, c, g, or t
gtttgttntggttttcaaataaatataaatatgatatatatagganctaatatagtaatgcaccatgtaacaaagcctagttcagtccatggcttttaattctcttaacactatagataaggattgtgttacagttgctagtagcggctgccattgggcagccgagtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataaaaaaaaaa

SEQ ID NO: 293787 - DNA, 2036 bp, Homo sapiens
gcagaaggaggaaggacagcacagctgacagccgtgctcaggaagattctggagcctaggctcatctccacagaggagaacacgcagggagcagagaccatggggcccctctcagcccctccctgcacacagcatataacctggaaagggctcctgctcacagcatcacttttaaacttctggaacccgcccaccacagcccaagtcacgattgaagcccagccaccaaaagtttctgaggggaaggatgttcttctacttgtccacaatttgccccagaatcttactggctacatctggtacaaaggacaaatcagggacctctaccattatgttacatcatatgtagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgatcttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 293788 - DNA, 289 bp, Homo sapiens
gcagaaggaggaaggacagcacagctgacagccgtgctcaggaagattctggagcctaggctcatctccacagaggagaacacgcagggagcagagaccatggggcccctctcagcccctccctgcacacagcatataacctggaaagggctcctgctcacagcgtcacttttaaacttctggaacccgcccaccacagccgcgtagtcagatcgagccgcgtagtcagatcgagccgcgtagtcagatcgagccgcgtagtcagatcgagccgcgtagtcagatcgag

SEQ ID NO: 293789 - DNA, 2725 bp, Homo sapiens
  misc_feature (96)..(96): n is a, c, g, or t
  misc_feature (112)..(112): n is a, c, g, or t
  misc_feature (128)..(129): n is a, c, g, or t
  misc_feature (142)..(142): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (194)..(194): n is a, c, g, or t
  misc_feature (204)..(204): n is a, c, g, or t
  misc_feature (222)..(222): n is a, c, g, or t
ggtctatgaggcaggacactggaggacgattcagtgtgactgggtcactgcggctggcactccctgagttccatatttcacattcatagggtcctncagtatactttgtgcnccaaatagaaagaggnncctgttggtttcngacagctgnancctntgagtcatagggaggctctgaccattcatccaccacnggtagcttgngtccggagtctcaggatnacaggttaagatcacagtttccatggccaccaaaagtttctgaggggaaggatgttcttctacttgtccacaatttgccccagaatcttactggctacatctggtacaaaggacaaatcagggacctctaccattatgttacatcatatgtagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgatcttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgttttcttcctcatacacctattaccatacaggggaagtccccaagctttcctggcctcacagattctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 293790 - DNA, 2214 bp, Homo sapiens
gcagaaggaggaaggacagcacagctgacagccgtgctcaggaagattctggagcctaggctcatctccacagaggagaacacgcagggagcagagaccatggggcccctctcagcccctccctgcacacagcatataacctggaaagggctcctgctcacagcatcacttttaaacttctggaacccgcccaccactgtctgaaaccaacaggaccctctacctatttggtgtcacaaactatactgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgttttcttcctcatacacctattaccatacaggggaagtccccaagctttcctggcctcacagattctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 293791 - DNA, 2139 bp, Homo sapiens
gtgaggcaggacactgtgggaggcagtcgctgtgatcttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgttttcttcctcatacacctattaccatacaggggaagtccccaagctttcctggcctcacagattctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 293792 - DNA, 924 bp, Homo sapiens
gagcgtcagaggatcccctgctgacagacatgccctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 293793 - DNA, 978 bp, Homo sapiens
  misc_feature (96)..(96): n is a, c, g, or t
  misc_feature (112)..(112): n is a, c, g, or t
  misc_feature (128)..(129): n is a, c, g, or t
  misc_feature (142)..(142): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (194)..(194): n is a, c, g, or t
  misc_feature (204)..(204): n is a, c, g, or t
  misc_feature (222)..(222): n is a, c, g, or t
ggtctatgaggcaggacactggaggacgattcagtgtgactgggtcactgcggctggcactccctgagttccatatttcacattcatagggtcctncagtatactttgtgcnccaaatagaaagaggnncctgttggtttcngacagctgnancctntgagtcatagggaggctctgaccattcatccaccacnggtagcttgngtccggagtctcaggatnacaggttaagatcacagtttccatggccaccaaaagtttctgaggggaaggatgttcttctacttgtccacaatttgccccagaatcttactggctacatctggtacaaaggacaaatcagggacctctaccattatgttacatcatatgtagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgatcttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctccgtgagtatcttctgttcctctgtgagccaggctgccatcctgtctaggaagtgaggagcgtctctgcccggattgccatcgtctgggatgtgaggagcccctctgacttgatagccagtctggaaaggggaatccctcttagag

SEQ ID NO: 293794 - DNA, 1333 bp, Homo sapiens
agcggggcgtgagcggcggccaggccgctctgcttggcgctcatgtccgccctgctccggaccgggccgcgcgctgtgccccgagagccaagaaggcaggagcgaacgcgggagctagagggcagggccgaggcgctgcggccggcccagagaggcccccgcacgtccagggccgccgcccggcgccccgaggggcagtcggcgcccggcgcgctcttctcggggcggtgggcaaggctggcggcctgacgcgggcgcgggagacgaggagacgcggagaagaaggtgtcccggctgcaggcacccctcgctgtctccagcaggaaggggcgactcaggtggcggtgcgactgccgctggtttcggttctggtgcgccatgacgggccgctgccgctttctgccgccgcgcttggcgccccgggcctccgcaccgcctagtctccggcggccgctgctaccgccgccatcctccggctcccacggcggctggcggctgagtgggaggcgcccgcccagactccgccggagccaccttccctcctcccccagccacccagccgttattaacggagaaagaggaaaaacgggtggcgcgcgaggggaggacgaagaatgggagggagggaggggtggcccgcgcttcccggcaaccgtcgcttccctccccctgcgagattaatttcacaggggattaatttctcatttacaaataaaaatgtaatcatagcctcctggtatcgcacatccatgggaatactgaatttatttggactagaaactaacacctgctggaatgtcaccagaatagaacctcttaatgaagttcaaagctgtgaaggcatgtttcttccaaaaatgctgtcatttgtaaacattcataaacatttaataatattatgattcactttaaagaattattgtaaaatactgttgttgatttaaaaaaaaattagaactggctcacctcaatgagtattttacattttaaagtagttttctgagaaggctgtgtacttacaaatttgagtataaattttggaatttgagtattaacatatcccattgtaaggcaaccttgactataagttagtcttctatttcagaatgcgaagatacagacagatgttttttggggtagcttcaatatataaattttgaggatagattaaagagtcaaatatctatttgtaatagctaatgtataaatttaattatgcatacatatttaaaaatcggatatgcaataatagattgatttagaaacattacttttttatatatgctcatagtccgtgagtagtattaataaaactcttcctatttatcttcta

SEQ ID NO: 293795 - DNA, 612 bp, Homo sapiens
cctccggcccccggctctggtcccggtcccattggccactccgctgctactggaaggtaatcatagcctcctggtatcgcacatccatgggaatactgaatttatttggactagaaactaacacctgctggaatgtcaccagaatagaacctcttaatgaagttcaaagctgtgaaggcatgtttcttccaaaaatgctgtcatttgtaaacattcataaacatttaataatattatgattcactttaaagaattattgtaaaatactgttgttgatttagagaaggctgtgtacttacaaatttgagtataaattttggaatttgagtattaacatatcccattgtaaggcaaccttgactataagttagtcttctatttcagaatgcgaagatacagacagatgttttttggggtagcttcaatatataaattttgaggatagattaaagagtcaaatatctatttgtaatagctaatgtataaatttaattatgcatacatatttaaaaatcggatatgcaataatagattgatttagaaacattacttttttatatatgctcatagtccgtgagtagtattaataaaactcttcctatttatcttcta

SEQ ID NO: 293796 - DNA, 1156 bp, Homo sapiens
agcggggcgtgagcggcggccaggccgctctgcttggcgctcatgtccgccctgctccggaccgggccgcgcgctgtgccccgagagccaagaaggcaggagcgaacgcgggagctagagggcagggccgaggcgctgcggccggcccagagaggcccccgcacgtccagggccgccgcccggcgccccgaggggcagtcggcgcccggcgcgctcttctcggggcggtgggcaaggctggcggcctgacgcgggcgcgggagacgaggagacgcggagaagaaggtgtcccggctgcaggcacccctcgctgtctccagcaggaaggggcgactcaggtggcggtgcgactgccgctggtttcggttctggtgcgccatgacgggccgctgccgctttctgccgccgcgcttggcgccccgggcctccgcaccgcctagtctccggcggccgctgctaccgccgccatcctccggctcccacggcggctggcggctgagtgggaggcgcccgcccagactccgccggagccaccttccctcctcccccagccacccagccgttattaacggagaaagaggaaaaacgggtggcgcgcgaggggaggacgaagaatgggagggagggaggggtggcccgcgcttcccggcaaccgtcgcttccctccccctgcgagattaatttcacaggggattaatttctcatttacaaataaaaatgtaatcatagcctcctggtatcgcacatccatgggaatactgaatttatttggactagaaactaacacctgctggaatgtcaccagaatagaacctcttaatgaagttcaaagctgtgaaggatgtcatgcccagagctgtagcggtcatcttgtgaccataagggaaaggccataaaaatagcagatatatctggcctaccatccttctgctgctgaaccaatgccaacagtgggactcaactaggaggtcttattacagtactgtgctgctttttcaaccatggagaggtcactcgtgtgatgtggacaccacctctccgtgaaagtttttcctatccatttcttgtacttcagatgtatattttaactttgattctcaggtaacttcgatttataaaacaaaggcaaataaattataattttagtgtcttaaaa

SEQ ID NO: 293797 - DNA, 352 bp, Homo sapiens
gcgcaggtgaccttgctcctggaaggcgccgcggctgatgcgctccaggtggcagctgtgcaggctgaggctctccaggagagggaagcatatgcattcatctcatgaatagcacagtgatctgagagcaagagttccagggccaatgcttcgtggctctgcttttgatcaaatgggtgacctttggatggttacggaaccgaaagagacctccattaccctgcctgtaaaaccgaaattatactcgtcattttcgcatagcgttttttttcaggatcaagtgtgactgttgaggtgaaacacatttactgtgcttaataaatgtgagctataattattaggatgatctaat

SEQ ID NO: 293798 - DNA, 380 bp, Homo sapiens
tggagttctattttgagatctctttttggatagcatttcaaagagtcccagaggatctctgacatctgagctctagctcaggctagatggattactcaagtgagtcatgtctgtgtggtgctctgaagtttacagagaacctttgcagggcagcatactcatcctggttcactcgtcctgtgtttgggatggactcatctcactcttgagcatgctgcctggaatctagggaaatggtctaccagtgtagcatttaagggttgaaatggactgggcatggtggcttacatctgtagctctagcactttgggaggccaacacgggaggatcactggagcccaggagttcgagaccagcctgggcaacatagtatgattctg

SEQ ID NO: 293799 - DNA, 490 bp, Homo sapiens
  misc_feature (7)..(7): n is a, c, g, or t
  misc_feature (42)..(42): n is a, c, g, or t
  misc_feature (53)..(53): n is a, c, g, or t
ataattnccgaaattaaaaacgacctcacctaaaggaaattngccccctccangccccaaaaatcggccaccaggaaaatgtaccccccccatactcctgtgcatgggtggggtggcatgtttcagaagtatattaaaaacacaaaatgttaatttccccttaaaaccatgactcatttgttccacacgattaggagtctcttaattggaccttaagaaaagttgagtttgacagagagaatagaagaccacctctaaagatgaagcacttgttgctatatcctggcataagataaaattgtttctagttaaaaattgtttgtagagctgcgtgtggtaggggcacacctgtagttccagctacttaggaggctgcggtgggaggatggcttgagcccaggagtttgaggttacagtgagctataatcacaccactgcattccagctcgggcaacagatctagactctgtctgtaaaaacataaataaaa

SEQ ID NO: 293800 - DNA, 4317 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggtatgtgatgggtcacactaacctgtcacttgttgggagcatgagcagctttctgtctggaacattaataatgatctaaaacggcctatttaatatgttacaaggcacttgagtatggttgcatgtccaaatataaatgtttttaaattaactctaacatttgtttataaaagtttaaccataataatagaatttttaaaacacgcttgtctggttgaatcttagcatatttttccaactaataaagctcagtattcgtctgtgttctcagagagagactgaggcatacttgtaaatatgtgtctgtgacaggccgtgctagaaagctctttcaggaaatagtagtgtagtagtagcttccaaaccacataatttactgctctccacaccagagaaaataactgagtacatttttaagaacacacagtttccagcttgtgtgagctctgcctatgctttctgccctccctgctgctgctgttccgtgcagtcacatgtctacccattagagggcagggaagggaggaaggtgaacctc

SEQ ID NO: 293801 - DNA, 925 bp, Homo sapiens
agggcgaggagaaagtcccacagcctttccagtcctggtcttggaagccacagccttcacttcctctctattctgttcatttgagtgaggtgctgagtcctgcccacactcagcgtttggggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaaggttggttggttttccgcaccctt

SEQ ID NO: 293802 - DNA, 761 bp, Homo sapiens
acatctctgacctttattttttaaatgaatcttgttttttgttccttaatttaccaggatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggtatgtgatgggtcacactaacctgtcacttgttgggagcatgagcagctttctgtctggaacattaataatgatctaaaacggcctatttaatatgttacaaggcacttgagtatggttgcatgtccaaatataaatgtttttaaattaactctaacatttgtttataaaagtttaaccataataatagaatttttaaaacacgcttgtctggttgaatcttagcatatttttccaactaataaagctcagtattcgtctgtgttctcagagagagactgaggcatacttgtaaatatgtgtctgtgacaggccgtgctagaaagctctttcaggaaatagtagtgtagtagtagcttccaaaccacataatttactgctctccacaccagagaaaataactgagtacatttttaagaacacacagtttccagcttgtgtgagctctgcctatgctttctgccctccctgctgctgctgttccgtgcagtcacatgtctacccattagagggcagggaagggaggaaggtgaacctc

SEQ ID NO: 293803 - DNA, 287 bp, Homo sapiens
taatttagagccattaacaagttttcttgacagtaagatcaatgacagacattaatggtattttattatgttatattacactaatatatacattaagtgtatatattacacttaactatatattaagaataaaataaacagtatacacacacacacacaaactcaaccccttttattttcaggtgagagagcgattacgagtagcacttgaaagatgtagtttgttagaagaggaattaggtgccacacacaaagaggccgcgaatttagtagtagtaggcggccgc

SEQ ID NO: 293804 - DNA, 5243 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293805 - DNA, 5415 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaagaatactgagaataagctctaactgttttggaaggcagtgtcaccatatggaaattgtattacagaagtcaattgacagaataaagcagccaggagatgaagtgcaggttcagggcgtcatcctgcccgctgctctggaggtcccgagcctgcatcactgcaggaga

SEQ ID NO: 293806 - DNA, 4802 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcactgctttctgggtctcctgccttcatccactgtgtgcgccgacttgcaggtcgagc

SEQ ID NO: 293807 - DNA, 4356 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctcgacatgttcggggtcctctagacagcc

SEQ ID NO: 293808 - DNA, 4202 bp, Homo sapiens
ctgggggtcaatttgaatgaagaaacggcatttactatagtttttttctctcttaagtatcttaatgtgtaatcgttaattacctacttttttgtcccctctgaaatacctaatttaggccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293809 - DNA, 5273 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293810 - DNA, 3204 bp, Homo sapiens
agggcgaggagaaagtcccacagcctttccagtcctggtcttggaagccacagccttcacttcctctctattctgttcatttgagtgaggtgctgagtcctgcccacactcagcgtttggggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293811 - DNA, 5333 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgaccacaggaaatgtctggttaacacacgaagagatggaaacgctcgcagccacgccgcaaacggaagatgaggagggaagctgggctcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293812 - DNA, 3458 bp, Homo sapiens
agggcgaggagaaagtcccacagcctttccagtcctggtcttggaagccacagccttcacttcctctctattctgttcatttgagtgaggtgctgagtcctgcccacactcagcgtttggggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293813 - DNA, 2952 bp, Homo sapiens
gcacagcaaatcgattttcaaagaagtttatggctataatttaaggcctgagtttttcacagtctgctgttaactaactttgcacttctctcacccctcagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293814 - DNA, 2610 bp, Homo sapiens
agtcatgctgctggtagcccagaaattgggatgcaaaatggccaaccttgttcttgaacacatgtggcacaatggagcggtggtggccagaccacgcctgcttcaccaggtctgcataggcctctgcgatccctgcgaacctatgacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293815 - DNA, 2784 bp, Homo sapiens
ccttgccctggatgtggttggtgcactggggtcaccttagaccacaggaaatgtctggttaacacacgaagagatggaaacgctcgcagccacgccgcaaacggttagtcacgccccacagcctgcactcctcccagcgcgttttccacttaagaccgtctgggttctttgcctttttgttgaaaacaaaatgttgttttccattcagtcgttccagataagtatttcctttagttattagttgaaatgtgtaagtagaatttgtattttattttagattttttccaggaacttcaagttggtagactctgtcttttagaatagctttaatctagctctccttttggagagatctcagttgagcctccatgtgactgactgtgtggccctttctccttccatgaatatgcttggcacggagagagtctgctccttgcatgagaagttgaaattgttggttttgcatgagttttgcatgatgctttgatagtctgaactttttcactcagtgaagctgcatcttccctgcagagttgcgttgcctgcattaccgagctcaccaatactaatagttatgttcttttgcattcctaaccacgtaaccccaggaagatgaggagggaagctgggctcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293816 - DNA, 2273 bp, Homo sapiens
ctgtttcagtgctgggagtaaacactgtgcagtgggtgtctcttctagttcagatgttctctggactgacatcacctggtatgttttttttccagaaggctgctaaggcagcccaggagaagagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcca

SEQ ID NO: 293817 - DNA, 4693 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagtaagtttttggcctaatgttctttaaatgtctgaaatgtgtgtaaatgtttaaatgtgtgtgaaatgtaagctgttattattattatacttgggacatcatgtagctaggcagtctctctggatgttagaagtcaggctttgctcttatacatttattcacaaatgagcctttaaaaactaatacctgggccgggcacggcggctcgcacctgtaatcccagcactttcggaggctgaggcgggcggatcaccagaggtcaggagtttaagaccagcccggccaacatggtgaaaccccatctctactaaaaaacacaaaaattagccgggcgttgtggtaggtgcctataatcgcagctacttgggaggctgaggctggagaatcgcttaaacctgggaggtggaggttgcagtgagctgagatcgcaccactgccctccagcctgggcgacagagagaaactccatctcaaaaagaaaccccctccccgcaaaaaaaaaacccacaaaagtaataccttcaagaaggtagttttgtttttatttttgctatttaatttttgacatccctcaaaaatggttttcacatcataaaacattggttgcagcttaggaacagagtctgtaagttgggttttggggaccagtagttatcctaccccagtccagagtgtacccccatactcctgtgcatgggtggggtggcatgtttcagaagtatattaaaaacacaaaatgttaatttccccttaaaaccatgactcatttgttccacacgattaggagtctcttaattggaccttaagaaaagttgagtttgacagagagaatagaagaccacctctaaagatgaagcacttgttgctatatcctggcataagataaaattgtttctagttaaaaattgtttgtagagctgcgtgtggtaggggcacacctgtagttccagctacttaggaggctgcggtgggaggatggcttgagcccaggagtttgaggttacagtgagctataatcacaccactgcattccagctcgggcaacagatctagactctgtctgtaaaaacataaataaaa

SEQ ID NO: 293818 - DNA, 3804 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaacatgatgataaaagctttaggagagcaccttcatgtagaatcttccttgatacctccgcgtgaatttcttctatgctttaccccttctatgcatcccattaaatactgtcattgtacgctctgctttaagtaccccacggctcggattctgcttcagctttgcactttactcctgcttacgtcctcctgtt

SEQ ID NO: 293819 - DNA, 3633 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggtgacgccaaacctgtctgtgtctgcactcattgttcagttggcaccctgattatagacagctagttattcgaatagaaagaaacttta

SEQ ID NO: 293820 - DNA, 3401 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacggtacgttcagagacaacccctgcattctttggaaacagggaatgcctctctgaaggtatcactgccctgtttacattgcttctccagttccttaacagcatatgaagtatagttctaattcaaaattttagcatcacatacattagaacttttaattttggggaattggatggtcaaaagaaactttattaaatgcttttatgaaagattggctagaatggcttcatagtataaaaatatgagcttttttaaacatagaaaagcaattacaaatttaaatatggaaatatgaaatacgaaaatacca

SEQ ID NO: 293821 - DNA, 3829 bp, Homo sapiens
gaattccgggcccccggccgtccctcttaaggctcttcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgaccacaggaaatgtctggttaacacacgaagagatggaaacgctcgcagccacgccgcaaacggttagtcacgccccacagcctgcactcctcccagcgcgttttccacttaagaccgtctgggttctttgcctttttgttgaaaacaaaatgttgttttccattcagtcgttccagataagtatttcctttagttattagttgaaatgtgtaagtagaatttgtattttattttagattttttccaggaacttcaagttggtagactctgtcttttagaatagctttaatctagctctccttttggagagatctcagttgagcctccatgtgactgactgtgtggccctttctccttccatgaatatgcttggcacggagagagtctgctccttgcatgagaagttgaaattgttggttttgcatgagttttgcatgatgctttgatagtctgaactttttcactcagtgaagctgcatcttccctgcagagttgcgttgcctgcattaccgagctcaccaatactaatagttatgttcttttgcattcctaaccacgtaaccccaggaagatgaggagggaagctgggctcaggttggagtctttctctaatatattcttcactacatgtacagcagcaaaaagcaattggagtatgaaaacttgtgtaatctactttttttgatgtttatagcatcttagtttattcggagtacaggattgttaatgatttg

SEQ ID NO: 293822 - DNA, 673 bp, Homo sapiens
gtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggtatgagtgcttttaacctgaaactatagatttttctccactaaatgtttttttattagtgtcatcttttgttaatgtttcagatgagtattttccgtaacgatttgtgaaatgatagtttctggtgtttgtaagtcaaatacaaagttcctagggattaaacttcttagggagaacaaatcgttgtactctaaagtcatgtgaaaatacctcattattttcattcctatctttgggaactgcctaggttcaggaagttctccagagtttttgaaaaagggctctgaagcaaccaatctatttggtgcctccattctgttgtcttaagccttttctggctaaacttgtacttcccatggattatctcatgtatttctaatttcctaatgtaatttaatagacaaataggattgatttcacg

SEQ ID NO: 293823 - DNA, 402 bp, Homo sapiens
gcaagtctgtaggctttgtctttattctgtttgatttcatttgttcacagtatgtgtcgggttatgtggaaaacagttgctaaagtaccggcttagagctgaagtggtcatgaaagttgtgtaatccaacagattgcataagtcagttttgattttagctatttcctggaagtatttttattttatagctcaccaaacaagggtatttaaggatttttttttccccctatcagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaag

SEQ ID NO: 293824 - DNA, 303 bp, Homo sapiens
gaagccacttttataattgtctttattcttttgcagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggtgacgccaaacctgtctgtgtctgcactcattgttcagttggcaccctgattatagacagctagttattcgaatagaaagaaactttaaa

SEQ ID NO: 293825 - DNA, 373 bp, Homo sapiens
catggagctcccattttatggagttcataagactgggttgtacttgtggctgtttcagtgctgggagtaaacactgtgcagtgggtgtctcttctagttcagatgttctctggactgacatcacctggtatgttttttttccagaaggctgctaaggcagcccaggagaagaggtgggtctccctgggatggagcctgatccttctgggagttcatgttataggccacttcaggagtctgagcagagcatataatgaggaaacagaaacaagtagggttctgcttccatgcagttttctatttagacaattcctttgtttaatttccccatttaagaatacataatcagcaagcaagagaataataccagata

SEQ ID NO: 293826 - DNA, 487 bp, Homo sapiens
gggttccaggagatcaaggacttcagggatttctactttcccatagcagatcataatgtagaagttctggaatgcaaaatcagtgtgaagagaactacccccaggttataggaggctatccggttgagaaatttgtggctaccatgtatcattacttcagttttgcctattataagtgaagcagttcagttctttaatgtgacccactccagaaggagctgtatgactttgctaaggaaaatataatggatgatgataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 293827 - DNA, 992 bp, Homo sapiens
ggatataaactgaaacatctgaatcttatttcttaaatgaagaatattaatttaaggatcaataattattttgtataatgggtatggcataagaaataaaaagtcctggatcttttccatgaggtggttggctctcaggttaagtaacaatgtaattgtaaaaaaatcttatgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatgggatcctggtcatcattggcttctgacggagtacgagaaaacacagaaatgaaacatgtggacacatgactcataggaggaacacaagtggacagacaacaaaccagaaagaaatctatgggtcgacacaaaatgcatccacagattgcctaaggcacatcaacccggcacaccatagataatgggaagagatggccctcaatagggcaggactgcagtaagacccaccgcaaaggcgtcaaacgatacagcaacacgtacacacacacaacggaacaaaactgcacg

SEQ ID NO: 293828 - DNA, 666 bp, Homo sapiens
  misc_feature (663)..(663): n is a, c, g, or t
ccggggacgcaacgcccggtttttttattcatgaccttacggatcgtatgagtgagcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatctcttcctggctcatatacggcaccctctaccttatccattctgcgacggatttacacgcccctttcattttcccctccgttttttccctcgcctaaaaataaagggggaggaaacacggcgctcgcgggaaaaacataaaaataggcnctc

SEQ ID NO: 293829 - DNA, 559 bp, Homo sapiens
tagttttgttgaatggaaatgtacatactttaatatatccgaattatttacattgtatttcaggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaaggtaagatggcagattattttcctcaggcaaaaatgttctgagtatcagtaagatgagagtttcactgtattcttgtggacaagatggggagaaatttagcctgaaagattatttttaggtagatttgtaatagcttgaaagctcttactcaaagggttatgattattggattgccttcatcgttgagagaaatgtctagtataatacttctccaaatgagttacaaggaaagaacactagttcttcatgatgttcatagagttaacttaaaaggagaactctgagtcaaatgtggtggaatgctagtttttaa

SEQ ID NO: 293830 - DNA, 233 bp, Homo sapiens
tagattattcttgagatatatggctgtctccgtccgagcttgccagtcatagtgactgaccgtgatggacatgcataaggaaggagtgcacgcactgcagtcgctgccacaaaaagtccgattattttcattggtacaggggaacatatagatgactttgaacctttcaaaacacagcccgccaggatgcttaccagtcgcgacgggtggacaacgacagccagagcacaagc

SEQ ID NO: 293831 - DNA, 2458 bp, Homo sapiens
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 293832 - DNA, 2719 bp, Homo sapiens
  misc_feature (2485)..(2485): n is a, c, g, or t
  misc_feature (2491)..(2491): n is a, c, g, or t
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcatgagccaccacgcctggcctccatgtttaatttttaaaactcaaaagcaaacatagcgaatgttaacatttgttaaatctggttggtagtttgactatttattatgtctgtttttctgtatgtaagatattttgtaatataaaaagaaaaatgagatagttatcactttaaaaacatctgctaagctctttgaagttatatattgcccatttgcacataactgctttgatgntgaatnataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgtcacaatataacaagtttgcacagatggtaagaatctggcaggcagagagtgtatcctctagagtcagctatgacaatggttagc

SEQ ID NO: 293833 - DNA, 2748 bp, Homo sapiens
  misc_feature (2514)..(2514): n is a, c, g, or t
  misc_feature (2520)..(2520): n is a, c, g, or t
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaagagaaaaataagcttgttattagttaacagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcatgagccaccacgcctggcctccatgtttaatttttaaaactcaaaagcaaacatagcgaatgttaacatttgttaaatctggttggtagtttgactatttattatgtctgtttttctgtatgtaagatattttgtaatataaaaagaaaaatgagatagttatcactttaaaaacatctgctaagctctttgaagttatatattgcccatttgcacataactgctttgatgntgaatnataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgtcacaatataacaagtttgcacagatggtaagaatctggcaggcagagagtgtatcctctagagtcagctatgacaatggttagc

SEQ ID NO: 293834 - DNA, 1228 bp, Homo sapiens
  misc_feature (1207)..(1207): n is a, c, g, or t
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaaacctggataacaattgggttaaagttgaagggattgcccnccaaattggggcaaggctttt

SEQ ID NO: 293835 - DNA, 2366 bp, Homo sapiens
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 293836 - DNA, 1135 bp, Homo sapiens
gtttcaccatattggccaggctggtgtcgaactcctgacctcatgagctgcctgcctcggcctcacaaagtgttgtgattacaggcatgagccaccacgcctggcctccatgtttaatttttaaaactcaaaagcaaacatagcgaatgttaacatttgttaaatctgggtggtagtttgactatgtattatgtctgtttttctgtatgtaagatattttgtaatataaaaagaaaaatgagatagttatcactttaaaaacatctgctaagctctttgaagttatatattgcccatttgcacataactgctttgatggtgaatgataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 293837 - DNA, 1208 bp, Homo sapiens
tacggtgtctcacacctgtaatcccagcactctgggaggctgaggtgagtgggtcacgaggtcaggtgtttgagaccagcctggccaagatggtgaaaccctgtctctactaaaaatacaaaaattagctgggtgtggtggcgggcacctgtaatcccagctacttgggaggctgaggcaggagaattacttgaacctgggaggtggaggttgcagtgagccgagatcacgccactgcactctagcctgggtgacagagcaagactccatctcaaaataaataaaaaataaaacactgggtacaattttgctaatagtggcttattcacagatataaataaagtattagcataaatcgtagccttaaaaaagccttttatatgtccttttatatagaattttacatggtcttcaaaaaatagtatgtaattgagaaaaagattagaagggaatatgtagaaatagaaagaattatgttagagtgataggattatgtaattttttcttagtattttctcagttcatcaaactttctattataccctgattatactgattatattacctcctacgctgactcaaaatctttttttttttcccctcaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 293838 - DNA, 1396 bp, Homo sapiens
  misc_feature (1162)..(1162): n is a, c, g, or t
  misc_feature (1168)..(1168): n is a, c, g, or t
gtttcaccatattggccaggctggtgtcgaactcctgacctcatgagctgcctgcctcggcctcacaaagtgttgtgattacaggcatgagccaccacgcctggcctccatgtttaatttttaaaactcaaaagcaaacatagcgaatgttaacatttgttaaatctgggtggtagtttgactatgtattatgtctgtttttctgtatgtaagatattttgtaatataaaaagaaaaatgagatagttatcactttaaaaacatctgctaagctctttgaagttatatattgcccatttgcacataactgctttgatggtgaatgataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcatgagccaccacgcctggcctccatgtttaatttttaaaactcaaaagcaaacatagcgaatgttaacatttgttaaatctggttggtagtttgactatttattatgtctgtttttctgtatgtaagatattttgtaatataaaaagaaaaatgagatagttatcactttaaaaacatctgctaagctctttgaagttatatattgcccatttgcacataactgctttgatgntgaatnataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgtcacaatataacaagtttgcacagatggtaagaatctggcaggcagagagtgtatcctctagagtcagctatgacaatggttagc

SEQ ID NO: 293839 - DNA, 1152 bp, Homo sapiens
  misc_feature (918)..(918): n is a, c, g, or t
  misc_feature (924)..(924): n is a, c, g, or t
agccagttttttgcccaagggaattgaccgggagtcattgccaaggctaagaaaattattgccattatggttagtttgaatgatcaggaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaagagaaaaataagcttgttattagttaacagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcatgagccaccacgcctggcctccatgtttaatttttaaaactcaaaagcaaacatagcgaatgttaacatttgttaaatctggttggtagtttgactatttattatgtctgtttttctgtatgtaagatattttgtaatataaaaagaaaaatgagatagttatcactttaaaaacatctgctaagctctttgaagttatatattgcccatttgcacataactgctttgatgntgaatnataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgtcacaatataacaagtttgcacagatggtaagaatctggcaggcagagagtgtatcctctagagtcagctatgacaatggttagc

SEQ ID NO: 293840 - DNA, 847 bp, Homo sapiens
gagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtatgtaaaatattgtatgaaatatatatgattgtatattgtcactagcattgggaagatggcttattcataatccctgtatttatatgtattttgatgtagacttaatacttgtagataaaagcctaaaagtggatacagtaagtagtgttttattgagaaattaactacaacttcaaatttacttcaactttctataaagaattttccaaaaaaaaatcgaaaaaaacctgaccttaac

SEQ ID NO: 293841 - DNA, 3071 bp, Homo sapiens
ctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggtgtccagtctgccagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttcttttttttttttttggaaatggagtctcgctctgttgcccaggctgggagtgcaggggcctgatctcggctcactggcaacctcgtgcctcccaggttcaagcgattcttctggcctaagcctccagagtagctgggactatagacttgcaccaccacgcccggctaatttggtattttgggtcgagacgggggtttggccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctgggca

SEQ ID NO: 293842 - DNA, 3021 bp, Homo sapiens
ttttagtgagacctctgcagacaggcccatcactgtccatgttccagggcaggtctgggtttccaagggaggggcccaggctacatccttggtttccccactgtggtgggggctgggactctgaggggctgtccagtctgccagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttcttttttttttttttggaaatggagtctcgctctgttgcccaggctgggagtgcaggggcctgatctcggctcactggcaacctcgtgcctcccaggttcaagcgattcttctggcctaagcctccagagtagctgggactatagacttgcaccaccacgcccggctaatttggtattttgggtcgagacgggggtttggccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctgggca

SEQ ID NO: 293843 - DNA, 3138 bp, Homo sapiens
ctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggtgtccagtctgccagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttcttttttttttttttggaaatggagtctcgctctgttgcccaggctgggagtgcaggggcctgatctcggctcactggcaacctcgtgcctcccaggttcaagcgattcttctggcctaagcctccagagtagctgggactatagacttgcaccaccacgcccggctaatttggtattttgggtcgagacgggggtttggccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctgggcaaaaaaaacgaagaagtaacacatgcatcacaacacgagcacagagaaataaacgacagagggggcgg

SEQ ID NO: 293844 - DNA, 2024 bp, Homo sapiens
ctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggtgtccagtctgccagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttcttttttttttttttggaaatggagcctgggcaacaagaacgaaactctgtctcccaaagaa

SEQ ID NO: 293845 - DNA, 946 bp, Homo sapiens
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaaaaaaaaaattgtg

SEQ ID NO: 293846 - DNA, 681 bp, Homo sapiens
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagactttccccataccagctgctgaagtggaccggctgaaggtgacgtttgaggatgccactgacttttttggccgtgtggtcatctaccacctgcgggtgcttggggagaaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaaaaaaaaaattgtg

SEQ ID NO: 293847 - DNA, 1313 bp, Homo sapiens
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaaaaaaaaaattgtg

SEQ ID NO: 293848 - DNA, 1605 bp, Homo sapiens
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcaggatatcctgcccctgcttctggggtgggtggtctgtgcctctggaagctttggactcacccaaacccgaatgggaaccctgatgtgtgatcttgaacacgtgacctctaggactccactttttctgtaaaatggtgctgatgaccacctgttctgtgtgagaggcttagagggacctgcagcttccccaggttgcccacatcggtggagtgtgagctgggtctggaaggggtgggggcctgcgggtgggaaaccagaaatcaccagtttcccttgactgcccacgctcacacactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaaaaaaaaaattgtg

SEQ ID NO: 293849 - DNA, 1207 bp, Homo sapiens
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaaaaaaaaaattgtg

SEQ ID NO: 293850 - DNA, 906 bp, Homo sapiens
gatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagtaagagtctgtggggacaggcagtggcgaggccctaagcctggggtcgagccctcagtggacagatctgggggtcaggccctccgcggagctgagagctggtctcagcccctctcttcgccttgatcctggtgcctccagggtgagttcagtgctgaatcgcaacactcggcagtttggaaaaaaacatcttttcgaccaggatgaggagacatgttggaactcagaccaggtgaggcgcctccctcgaccctccatctctagggtgattcagattcagatctcatgccttgagaacgtcagggggccctcatgggtggccaggaaaggaacatgtgccgaatttccttcttcccctccattccaagaactatgtgaatgagacaggcatagcagggctctgtgcctgcagtgagcttgcgcctcagtttccctgtctgcttccagggcccctcccagtgggtgacgctggagtttccccagctcatccgtgtctcccagctgcagatccagtttcagggtggcttctcca

SEQ ID NO: 293851 - DNA, 792 bp, Homo sapiens
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293852 - DNA, 953 bp, Homo sapiens
  misc_feature (859)..(859): n is a, c, g, or t
  misc_feature (882)..(882): n is a, c, g, or t
  misc_feature (921)..(921): n is a, c, g, or t
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattcccaaaaaaaaaaaaaaaaaaaaatttgtgggggcggccggaaaaatttaaaaccttggtgggggggcccnaggataggaagggcaaggtccangaaccggcggaagggggttcccaaaaacgcgggccggtngaaacaaggggggggctgggtcccggcaagcg

SEQ ID NO: 293853 - DNA, 958 bp, Homo sapiens
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293854 - DNA, 783 bp, Homo sapiens
ggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctgattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293855 - DNA, 864 bp, Homo sapiens
  misc_feature (770)..(770): n is a, c, g, or t
  misc_feature (793)..(793): n is a, c, g, or t
  misc_feature (832)..(832): n is a, c, g, or t
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaaaaaaaaaaaaaaaaaaaaatttgtgggggcggccggaaaaatttaaaaccttggtgggggggcccnaggataggaagggcaaggtccangaaccggcggaagggggttcccaaaaacgcgggccggtngaaacaaggggggggctgggtcccggcaagcg

SEQ ID NO: 293856 - DNA, 1092 bp, Homo sapiens
ggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctggtgggcgccgcgcgagccttgttccctgccctcccctcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctgacgctgattgtgttccttttccacaattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293857 - DNA, 706 bp, Homo sapiens
gagagagagatagagagagactgtgacacactgagagtgcgcaagcgacgcttgcgcggagaactcagcgctgattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293858 - DNA, 1258 bp, Homo sapiens
ggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctggtgggcgccgcgcgagccttgttccctgccctcccctcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctgacgctgattgtgttccttttccacaattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293859 - DNA, 741 bp, Homo sapiens
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaactacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaacttgaccttctcttagattatgttcaatgaatattgtaaatgttcaagtattgttaatgaatagaataaatacaatattgcattccca

SEQ ID NO: 293860 - DNA, 390 bp, Homo sapiens
acacatattactttataaaatttaaatttaaaaaacatgttggctttgtgaccgactcttgagaattacaacttttttaaagtgtctattatgtactttaatattctctttggcagatattgggcagttgcattacctgtctacctccttattgctatagtaattggctacgtgctcttgtttgggattaacatgatgagtacctctccactcgactccatccatacaatcacaggtaactttatataaaaggaaagtgctggggcaatgaaagagtggagtattagcacttttacccagaaaagcaacaaagaacaggctgcaaaacccatgttggtggtgcgcgtctgtaatcccagctacttgggaggctgaggcaggagaatcact

SEQ ID NO: 293861 - DNA, 445 bp, Homo sapiens
ttatttatagaatatgttgaggaattgaaaacaaagatctagacttaaaatccaattagctccctcccgtaaaaaaatccctcccgtaaaaaaaggctatatcttaatttagagtaattgagaaatgatgcaggtcttaaagagtacaacttaaaaaaaaatcagttccgataaggtatatttctatagcatcttaacagtaacatgtttgtaaacatatttccccagagttctcattaggtagcaagaaaagcgatcacctaccaaccactgcacacttgtatgtcatcagagaagccaaagcttttacttcatctacactcacatcagtgctataacggatacctggtggtgttttttaaaaaatgtgttggggtgggtgagaaagaaggggttatatttagaacaaatttcaataagtttcaaaaaagaaagctacaaattg

SEQ ID NO: 293862 - DNA, 490 bp, Homo sapiens
gtcgactctagaggatcccatatatccggcctatcgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacaggtatgttccttggtctttctttctttattaattttttaagggaaagaaatgtaggatctacttacattgagtacctgctatttcctaggtgatgtgtttggttgtttgtatacattgcccaatttagttctcacagcatccccgtgagttaggtattttccgcatctgaggcttaacaagttgggtcaaagagaaggaagttaatcagtgataccatactgtgagcaagtcatttaattctcttattaatgacaatgtaatattatagaataagcataaggtttggaattacatggacaggcttctaagg

SEQ ID NO: 293863 - DNA, 6247 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293864 - DNA, 7002 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293865 - DNA, 7083 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293866 - DNA, 7064 bp, Homo sapiens
gcagtgtgggcgggggccggggggccgagaggtaccgccgccaccgcgcggggagccgcagcggttccgagcggggcccaacatggcggagagagaggtggagtccggcccccgaaagagggaacatcgtgatcaattagccactgccaaagatccctgctggccaaaacattctgattaccgtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293867 - DNA, 7074 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccagtactgagtccttaaaggaaacagttatgagaaaattgtgagaaatacaagcaaaaacaacaaaaacaaaatatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293868 - DNA, 5939 bp, Homo sapiens
  misc_feature (91)..(91): n is a, c, g, or t
ggtgtgagtgcatggaaatattgcttaattttgtcttcaatcattggagtgaaaaaccttgtaacttgtggcctggcaataggtttatgcntgtacaggcataaactgattgcctctgttttatttagttattttagctcacagaaaggaaaaagaaatgaattataccatggcttatgttatttttttcttatttttagagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293869 - DNA, 5232 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaacttttta

SEQ ID NO: 293870 - DNA, 6629 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccaga

SEQ ID NO: 293871 - DNA, 3571 bp, Homo sapiens
atatggattggattaaataatctctaaagccctttcttgctctaagaactctgaatctttaggatataaaactaaattctttattctacaaatgtataccctttccagctttgagaaccctgactcttaaaaatccaaaactaaattttatgttctgtaaatttttggaattcttacagggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293872 - DNA, 6502 bp, Homo sapiens
gcagtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaata

SEQ ID NO: 293873 - DNA, 3239 bp, Homo sapiens
atctatgtggattttgaaccacaaaacaaattaccttgtcttcataattattttatgaaaatgtcttcaaaagcaagaatcactgctattgtttgatctttacaactgttgtacaacctttatgtgatacctaatctgtagttattttgttatttgtatagaaaagaaattttgttttgctaaagctataatagaaaaacaatttttaaggaattgaaattttctaagtagtccttttcttagaggaactttatgattttagagttgtaacacttttttttctgaaagaaatgtaatagcttcatttgccctttgataatgtgtattgagtgcccttggagttcattccaggatattgggcacttccaatatgtggtgcttggccatagtgtcacatgtgagttgacttttttgttgctcttaataatgtttgaagtactaaagtttatgatttacactttgtcttatattaactttatactcacttccaatccattgtgatttcagttgattcctgggaggaaatattcctgtaaactatttatctctgtgggtaccttgctttccccattgtgagtcacagtggagaaaggttgagagccatattaggttggtgcaaaaataattgcagtttttgcccttacttttaattacttttaatggcaaaaacctcagtttacttaagaatagtacatatttcctatactctctgatttctaattttcttttttctctttttttttttcccctgtggatagttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293874 - DNA, 2702 bp, Homo sapiens
acccggtagcagccaatatggaatcccacgtgattgtttgcattcattttgactaaaaacccaaggtagggagaagcctagagactttgcttctgtgtgatacattatatatcttcagcataagtgtactgatgagtgaagaatagaaaaatgggatgattattaaatgaatggttattctaattttcttttttctctttttttttttcccctgtggatagttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293875 - DNA, 2679 bp, Homo sapiens
tttaaacttcctgttgctctgtgtagtcccagtgatggctgaaggcattgaattttacattctagattggtctcaggggtccacagctaggtaagttataccttttcccacacatagtagtgcttttatggaattaattactcaaagctgatttttctaattttcttttttctctttttttttttcccctgtggatagttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293876 - DNA, 2538 bp, Homo sapiens
tctctatcgttatcactctatccttaatctctccataccttatctctctatccttaattctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293877 - DNA, 1277 bp, Homo sapiens
gtcagtatagtggatacccgcgtaaagtaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaga

SEQ ID NO: 293878 - DNA, 219 bp, Homo sapiens
ttaaagttgcagaaaactaatacttctacctaatgttaattttatctttcctgatttttaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatataca

SEQ ID NO: 293879 - DNA, 449 bp, Homo sapiens
gagaatacgtgagactgtcataaaccctgggtattttgaatcaaaccatgggtcttttactgttatgtgacctttggcaattctgggcttgaactttcctactgcgtctctttgaactttaaatagagagaaatctgaagattgcggcagctgcccgtctcctggctgccaattgtctgcagagtgatgtaacatgaagaaaatgttctataaagaaggtgtacagaggaaaaacaacattccacctatacaagtgctatcaaggagaagggtgatatattagaaagaaaggattttgatgttggagagacttgggttcaaattccagctctttctgtaatgaaagccaagttgcttaacctgggaatcagcttctttagttttaaaatgaggataataatacctactcatgggagtcgcataaagatgaaatgaaagtctgtatgaaa

SEQ ID NO: 293880 - DNA, 2169 bp, Homo sapiens
ttaagagacagtgtcttgctctgcctcctaggcaggagtgcggtctcacgataacagttcactgcagcctccatctcctgggctcaagcaatccacccacctcggcctcccacgtagctggggctacaggcacgcatcaccatgcctggctcttgtcagtatgaatccctgctgtgtccccagcatctagagcagagcctggcacatggcaggcccatctttgtggagtgaactgggaacaggagcgctgggatggtggagtgttctaagtgagacagccacagtgcccgtcctgtttgctcctctcgcccgaactgccactttcagtgtcaggactgggaagagcataggcagaaaggcctggaatccagggagccccaggctgcccactgcccaccgcccacctcagcctggcccagcactcagagggtctcccacctcggcctggcccagcgcacagaggcctcccacctcggcctggccaagcgcgcagaggcctcccacctcggcctggcccagcgcgcagagggcctcccacctcggccttgcccagcgtgcagagagtctccaggatcttgtgctgcagcaggtactccaggcagggccctgcctcacccgcggccgcctgctgctgctcttcatacaccaggatatccagcatctgcttcagccgccagggaatgtctgtcttcttggcgggggtgctttcatctaatgatgtttgggaaacaagggtgagtagggtaaagaggggcaccccggcttgaaaacttcaccctctcctgccaaagcccagaaaggggaggtcctgtctgggagaggtgggggaagacagctgctggcaactgggaaatggaagtttacagtgaatgcttcaatatttaagaagacaaaagtccttccaggctcaggacacagtcctctgagaacgcatgcatgcccagccctttatcagggggcagcagcatcggtttccttcaaaccctaggatgggtacagagacagggacacatggtcctgggcccacagaaggctgctgtcagctctgggcctgagtggacactgtgggctcagggctcttgtcacataacttagaagctgtaattccagcagctgcctgagagagaacctcctggggcctcccccactgacactcagagaaggcaaacctctgtttttcacaaagcagaaaaaaacatctgtgccaccaccttcaggtctgacccagtcctgctccctgtaccaacgccctgacggggaagctacttagtgggggcttttgcagtcagagtctcagtgtgtgttttaaagaaagttctggtgcttcagggctagacttggagcaccccctagctttcctttaaggaacaggagcttgagtagggcggcctgccccacgcacttccaacccttctggtctagggaccattctggaaatgaaagggctggatgggggaagccccaggtgaatttcagccagttctgatctgatcttactgagctggtggactgaggctctccttcaagagatctttaacctgaagagatggttcagaaccaggggtgcgcttttcccccccagggaacatgaggcaatgtctggagaccttcctggttgtcccaattcgggggtggggtgtgctactggcacctagtgggtagaggccagaattactgctgcacatcccacaccgcccaggacagccccgcgcagggaaggctccaggtccaatgccaactgtgccaagattgagaaacctggtctagcagaaccctcagagggtcccacagatttctgaatttcctgggctggcccgggctggaaagaaagcctgtaggaaaggtgtgggctgggatcaagccccagtatgaactccaggaagggaaaagtgagggatgcaggatatggttacctggcaaccagtccgtatccacccatggcagcctcatgactgcagagcagccactcagatgccatcccctcagtgagcggtcctgatgggaccaggtgccaaggctttggctctttggggtgtcagcttggagagagggacccaggcatgttacccaccttggttttcgttctcctcctaccccagatctctacaaggacattgcccctaagctggctcaggggaaaggggaatttattaaattcttttcttttga

SEQ ID NO: 293881 - DNA, 700 bp, Homo sapiens
  misc_feature (107)..(107): n is a, c, g, or t
  misc_feature (120)..(120): n is a, c, g, or t
ccaatattcattctgggcccatccatacaggccagaggcaaatttatctacataatacacatgaaatagtacttccaaaagaaaaaaataaggcagcttcataaccnattattctttacntttaacaatataacttctcccgttcaagactcgtgccgaattcggcaccagatcatggcgatggtttcccccttactgttctcatggtagtgaataagcctcatgagatctgatggttttataaggggtttccctttgcacttggttctcattctctcttcccaccatgtaagacatgccttttgccttctgccatgattgtgaggtctccccagccacgtgaaactgagtccattaaacctctttttctttattagttacccagtcttgagtatgtctttatcagcagtgtcagaacagactaatacacaagggtatacatttcattaaattgaactattagaagatataatgtatatgtatatactgtgttttatttgcaagagcgacaattgttggtgacaagtttgcttgtttggaagaaaagtctgatacactaattaagataaagtgggagaagggaatagcctattttattatttttcttaacttttatcttgtaaagtcattgttttcaaagccaaagcaccatggaaacttcttcactgattctaagagcattaaatattttcaaaaagta

SEQ ID NO: 293882 - DNA, 2182 bp, Homo sapiens
  misc_feature (1318)..(1318): n is a, c, g, or t
actcagtgcagagggaaattgacacagccatgatgaggcctggctcacaagagccatagttactgtaggagtttctgtggctaaatatgcttagctattgaggcaaggacatgtgctggatgtgtatgcagtctttgaagctggagaggcctgtgttggaaactgtgctctgtcccatgccagttccctgaccttggaacccctagagcaatcaacagacagacagagccctgcttcatggagcgtctgctctctcctggagctcacacgctgaaacagacaggatgcaacacctcagggttgttggagaaccagaggctgttgcaattaggatggcgaatggtgaaaaacagtgtggttgaattgaacataagctgaagggctagacatcatggcttcaatccttgtggaggagccttcatctaccacataagaattgcagcaaaccctgcagctatcctgaagctgccatgctgaaaaggccaattgggagaccacatagagaccgagagagacttccaaggactccagccaatcctgggccccagcagtttgaatctcccagcaatgccaccatacaggagagggagcaaatactcagaagattcaagtgccagctgcatgggttgatacctacataaaaggcattgggtatgtgctcttgggtgattcccctaatcatagtggaaagatgggagctgagactctaagactgtaagtaacttggccaagacttatggcttgatacggatcttctaactcaaaatcgtgtgttcttctcactacccaattattgcttcacacttcatcattttgcagatgactgtgtgttgatgagaggctgccataatttgaagtcattagaacaatgaaatagtatctgcacatatgcacagtcctcggatgcgatgggcattccctcaagctgcagtccagcaggaaattttcagtgctagaagagttaaactataagctgacttgagatgtagtagttcaaaacccttgccaataactctttattatgtgcagcattttcaaagcaaaattacaacatgttagaaagtgaatgaggcaaattactggtgatgtcatcaaagtaataactgctaatgacccttttactcctgggcattgcctgaggccacactgacaggaagagcagatctgctttctgtgaatccatttggattatctagaaggcatcctgaaagttatgaaaacataatgtgagaaaatgatagatcaaagtgtgaatacaatgcagggacaacagaaaggaaaatgtactctctgttgtgtaatgggtattttggccagngtttgaagagctttattaaggagtgacaacaaacatatatttaaatgatgacatttcctccaaaataaaataaacaaataaatatgtagaatttaaaacttttttgtttccatgaaagagtttggaatacccttccaaactctcctcattcattgagacgatggatctcttgttattaaccgagacactgaattttgaggtgacatcctgttctggaggcagaaacattgccagcacttctccttcagcagttgatttattatgtgacagtcggtgatgagcttatcctcatgaagatgctccctcccacggacagccgtatcatacttgaggcctccctgccacttacccaggccactgcaatagcccctttgttgtcatctggttaagaactaaggttcttccttaaccagtccattcccctgacttccacagagaaaccattctataaactgctcatctgtcagctgttcaccagctcaaaaaccattcagaatcccacaccttctcccactgtccacagaatattgtcagtactccttctaagagaattcaaagcaacatgacatcatcctatatttctagccttacctaataaatattcataccgactacctactgctttctatacagggaaacatttcaaggcctccgaggtctgcttggaattctcccatccaccatcatttctgctgcctattaatattccacctataatttattcaccaaatattccttgaatgagtgccaggtgtcagatacctcagttccaaggtcctttcttttgtgaagcttttcttggaagctccctttctgagctcacactctaattgggacattatttaattatagtctgtattgaac

SEQ ID NO: 293883 - DNA, 369 bp, Homo sapiens
actcagtgcagagggaaattgacacagccatgatgaggcctggctcacaagagccatagttactgtaggagtttctgtggctaaatatgcttagctattgaggcaaggacatgtgctggatgtgtatgcagtctttgaagctggagaggcctgtgttggaaactgtgctctgtcccatgccagttccctgaccttggcttcggaagtcccatttaacaactgctcccagtacagcatgagaagtgacccagagcacagcgatcgcacgcgcagcgtgctctacagaaggtgcatccacagatggcgggccagccggctcccaatatagtttttaacataaatgatgaaaataaaaaccctgaagaaaaa

SEQ ID NO: 293884 - DNA, 511 bp, Homo sapiens
actcagtgcagagggaaattgacacagccatgatgaggcctggctcacaagagccatagttactgtaggagtttctgtggctaaatatgcttagctattgaggcaaggacatgtgctggatgtgtatgcagtctttgaagctggagaggcctgtgttggaaactgtgctctgtcccatgccagttccctgaccttggaacccctagagcaatcaacagacagacagagccctgcttcatggagcgtctgctctctcctggagctcacacgctgaaacagacaggatgcaacacctcagggttgttggagaaccagaggctgttgcaattaggatggcgaatggtgaaaaacagtgtggttgaattgaacataagctgaagggctagacatcatggcttcaatccttgtggagaatgacttgtgaattgccacctcctgcaaatcctgtggcctatgatctggaccaaatcacatccaagtgtctgatcagttctgagagtggttgtggatg

SEQ ID NO: 293885 - DNA, 759 bp, Homo sapiens
ggcacaagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtccgatacctggaaattagcttagtacacaagactcccaattactattttcttccttcccagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttagaaccaattttattgagcggttctggaggaacatacttctgctccccttgcataaaggatctctatatcctagaatcccaggtttaggtaaagagttgcaaactggaactcataaattatcatagtcttcacccagtctgtctcttagaatttatttcccactgacacaaacaagccattttgtctgcttgtataaccc

SEQ ID NO: 293886 - DNA, 858 bp, Homo sapiens
  misc_feature (20)..(20): n is a, c, g, or t
ctagtggatccccggggctncaggaattcggcacgaggagtaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtaagggtcagtgactcacactcaagttcacctagggcctgtcttcgtgcctaacatttgatttctttactagtcatgttaatctgcagaatatcttcttatctctgcctttgggccatatttctgtagcagaggccctattgcatgtcccttgactcttttttgtgttccttcatcctcagtgccctcttctgattaaagttcattttctgttctgagtacatggtagctaatttccttaaggtcatgagaactatctagaaagcttcatacaatatgttccagtgttcctggcaaggcacgatatttattgattgatttattattttgtgtccagggtgtccctaagcccttatgtagttgtttgacatgagctttagggtctgtattcaaatactttttataaattcttttcaaacttttgccctcagagaagaataaagtatatttaagtgacgatgatacgttcaggaaatacattcaatgattacagaatagtaaagatttcaacagggctctttcctcccgttgccccc

SEQ ID NO: 293887 - DNA, 716 bp, Homo sapiens
  misc_feature (20)..(20): n is a, c, g, or t
ctagtggatccccggggctncaggaattcggcacgaggagtaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttagaaccaattttattgagcggttctggaggaacatacttctgctccccttgcataaaggatctctatatcctagaatcccaggtttaggtaaagagttgcaaactggaactcataaattatcatagtcttcacccagtctgtctcttagaatttatttcccactgacacaaacaagccattttgtctgcttgtataaccc

SEQ ID NO: 293888 - DNA, 867 bp, Homo sapiens
agcgagtgtatcccactgaggccccttggtcgctcccactcgtcgtgccctcacctagtcaggtcccgcagccgcgcctcctccccgcgcagctcctcggaatgcgtgggggcttcctgcaacatcagtctccgccgccctccactaaatcgcgaccctgggaaggtgtttccactgtgcccatcacactaggggaaattgaggcggaggcagggtgcgcaggcaaagagcggcaagaggacagctgggaggaaaaccctcacagagagcgtgacatctgagccatctgaaggataagtaggactgtgtcaggattatcatgctggcttcagcaggtagagctgatgggaggaggtaagacaggaaggaactgcatagtccagtaaattgcaacagaaggaacagtgcatcagttctgagcctaggtgtccagaggccttgcatgctttggctctctcttttggggctctgcccaggcacccagggaacaccctgggctagcctgctggagtgtgagagatcatgtgcggcagtgctcagccaacccagccgaggccatcagaaattagccagcacccagtcaacttggcagctgaccaccaacagagaagtggactcactcaagaccagaagaaatatccagctgacctcagtcaaaactgctaacccacacaatagtgagatatatacatagctgccgttttaagccactaagtgttggggtaattggttttgcagcaaaagtagactgatacagaaattggtgtccgaaagtgagatgttaggccattaacaataccctaaaatttgtgacattagctttgagattgggagtggttggaaactgggaaaatggcaagagcaaac

SEQ ID NO: 293889 - DNA, 1765 bp, Homo sapiens
ggaattcgccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgagggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcatggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaaggatgggaaacagcccgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttgctcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtgtgttagtctgtttgcgttgctataaaagaatacctgagactgggtcatttataaagaaaagaggtttatttggctcaccactctgcagtctgtacaagggggtgtggtgccggcatctgctcttggtgagggcctcaggaagcttacagtcatggcagagggggaagcggcgccagcgtgtcacatggtgagagagggagcaagagacagacaggggaggaaattccaggctcttttaaacaaccagatcctgtgtgaactcatagagctggaactcactcattactatacagatggcaccaagccattcatgtgggatttgcccccataccctaacccctcccaccaggctcacctctaacattggggatcacattgcaacatgagatttggaggggacaaaataccctgatgatatcattgtaccagtaccacccccccgcaaatgtcatgttcttctcacattgcaaagtacagtcatcccttcccaatagtcacccaaagtcttaacttgttt

SEQ ID NO: 293890 - DNA, 444 bp, Homo sapiens
  misc_feature (17)..(17): n is a, c, g, or t
  misc_feature (24)..(24): n is a, c, g, or t
ctactactactaaattngcggcgntcgacgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293891 - DNA, 214 bp, Homo sapiens
gcggccgcctactactactactactgctcgaattcaagcttctaacgatgtacggggacatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293892 - DNA, 504 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293893 - DNA, 1246 bp, Homo sapiens
  misc_feature (10)..(10): n is a, c, g, or t
  misc_feature (14)..(14): n is a, c, g, or t
  misc_feature (89)..(89): n is a, c, g, or t
atcgactccnatgngaggccctgcgccattgcgttggaacccgcgaattcggccattatggccggggctcttccggggacgttgtcttnaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaatccagttctctatgtgaccagttctctgtatgaatggaagggaaaagaattaaaaatcttgcaaaggggaaagttccatcttcttaaaaactagatgtggtaaacaactattctaaaccaggagtagaaaagctaacactatctggctggacacggtggctcacacctgtaatcccagcactttgggaggccaaggtgggtggatcatgaggtcaggagatggagaccatcctagctaacacagtgaaaccccgtctctactaaaaatacaaaaaattagccgggcatggtggcaggcgcctgtagtcacagctacccggaggctgaggcagaagaatggcgtgaacctgggaggt

SEQ ID NO: 293894 - DNA, 380 bp, Homo sapiens
taccaaattcgcggccgcgtcgacacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293895 - DNA, 416 bp, Homo sapiens
taccaaattcgcggccgcgtcgacacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaagtcgacgccgcaatagtatagtagc

SEQ ID NO: 293896 - DNA, 632 bp, Homo sapiens
  misc_feature (437)..(437): n is a, c, g, or t
  misc_feature (446)..(446): n is a, c, g, or t
  misc_feature (451)..(451): n is a, c, g, or t
  misc_feature (455)..(455): n is a, c, g, or t
  misc_feature (468)..(468): n is a, c, g, or t
  misc_feature (473)..(473): n is a, c, g, or t
  misc_feature (476)..(476): n is a, c, g, or t
  misc_feature (481)..(481): n is a, c, g, or t
  misc_feature (484)..(484): n is a, c, g, or t
  misc_feature (490)..(490): n is a, c, g, or t
  misc_feature (492)..(492): n is a, c, g, or t
  misc_feature (494)..(494): n is a, c, g, or t
  misc_feature (502)..(502): n is a, c, g, or t
  misc_feature (513)..(513): n is a, c, g, or t
  misc_feature (516)..(516): n is a, c, g, or t
  misc_feature (524)..(525): n is a, c, g, or t
  misc_feature (536)..(536): n is a, c, g, or t
  misc_feature (541)..(542): n is a, c, g, or t
  misc_feature (546)..(546): n is a, c, g, or t
  misc_feature (553)..(553): n is a, c, g, or t
  misc_feature (555)..(555): n is a, c, g, or t
  misc_feature (563)..(563): n is a, c, g, or t
  misc_feature (594)..(595): n is a, c, g, or t
  misc_feature (609)..(609): n is a, c, g, or t
  misc_feature (612)..(612): n is a, c, g, or t
  misc_feature (616)..(616): n is a, c, g, or t
  misc_feature (618)..(618): n is a, c, g, or t
  misc_feature (625)..(625): n is a, c, g, or t
cctcttccggggacgttgtctgcaggtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaacaaaaaaaaaaaaaaaaaaaaaaaaaaaaagtggcgcggcgcgcgcctccgggccctcggagaaaggttttnataaacccnttcgngtgngggccgccggggncccangtnagggnaangtagancntngggccaanacggtggtccncanagggaganncccggggccangagannaggnggcgggngnttctcccncccaaatataaaaaaaggcgccggggggggnnaaccccgagagcgngtntctntngaacaanatcctcc

SEQ ID NO: 293897 - DNA, 541 bp, Homo sapiens
ctttaccttttaattttagttcttaacacatagccccttatgtgttgttttttactgggaattttcaaaaatatggttaaaatattctaagacattttgcaaatcaagaaataccactattcctggatcctaacaataaattagagctctcataagtggtctcctgtggggatgacttcatagtttatcttgactcagaaggaggacagataactactggcatgaaattgaaggattatcctgctttaaatgaatttcaccttttaagttttactctgtatttgtgtatcctgtagtttcctgggttccctgattgctttgcttggttctttaccatgtttgccttctctgtgctaaataaaaaatgaagttcattttaaagaaatgattaatttggtattttcctttctaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293898 - DNA, 291 bp, Homo sapiens
aaaaaaaaaaaaagaagaagaaatctcagcaggctgagatggaactcattcttctcatgaagaacgtggcaagcattatacagaggggccatagtctggaaagcaggagatgcttacagacatataagttgtttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293899 - DNA, 206 bp, Homo sapiens
gcggccgcctactactactacaaaattcgcggccgcgtcgacggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293900 - DNA, 209 bp, Homo sapiens
cgcttcaggttaggaaagcctaattcaaggaagcatgggcaggtggtgtcatccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293901 - DNA, 481 bp, Homo sapiens
cagagtaagattgtgaagcagttctgaatgttatgatttttccctaaagtatattatttattgccggtaataattattctgccattattaggtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattg

SEQ ID NO: 293902 - DNA, 296 bp, Homo sapiens
  misc_feature (293)..(293): n is a, c, g, or t
  misc_feature (295)..(295): n is a, c, g, or t
gcggccgcctactactactacgttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaagtcgaccggccggaatttagtagtagtagngna

SEQ ID NO: 293903 - DNA, 463 bp, Homo sapiens
gcagggtccggcgagttcgggtggtttcgctatttggcttctgcgtccaaggcccatgtcaaggaagagaaaaatgtgttagaagtttctgtcttgcttttggagatgcaaacagaataatggcttcataaatcactcgcactggttttacgtgtcaagttttggtgtctggtaattctgttttagtttaattttagtgagaggcttgtgacaacaaatgaggtggttacaaggggtggaatgggaagattaaattagttcaagtattgattatgttttacgttgggtagttcccttaacgaagttgctcgtatgcatatctgtataaccgatttgctaaataacatcacgatgtttccagaagtgggaagaaagcaggtgccataacccaaagaaacttgtgtaatatcaaaattagtattaaagggtatgcctttacgcagaaacgcagaacgcgcctaat

SEQ ID NO: 293904 - DNA, 909 bp, Homo sapiens
  misc_feature (117)..(117): n is a, c, g, or t
cactgggtgtgaaacaactaattgtcggtgttaacaaaatggattccactgagccaccctacagccagaagagatatgaggaaatgttaaggaagtcagcacttacattaagaaaantggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaatctgtcgaaatgcaccatgaagctttgagtgaagctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293905 - DNA, 612 bp, Homo sapiens
acttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagttttgaagccacgtgggacctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293906 - DNA, 475 bp, Homo sapiens
ctctacagagttgttggacggaaagaggagagtgggcccacttctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293907 - DNA, 544 bp, Homo sapiens
cctcttccggggacgttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293908 - DNA, 610 bp, Homo sapiens
cctcttccggggacgttgtctgcaggtatggatgttgttctcttttccctgtctttatttccttaccaatcggctgccatccgaggagctgaggaagcctagagctctcagaagcagtcctttgagctggtgtagggcggtgtttctccaactgggctcgtggcacttttctggacaccactccaaacaaaattagactctgagcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293909 - DNA, 456 bp, Homo sapiens
tcgggtacccacacgttacgccttcctctcccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293910 - DNA, 498 bp, Homo sapiens
  misc_feature (10)..(10): n is a, c, g, or t
  misc_feature (14)..(14): n is a, c, g, or t
  misc_feature (89)..(89): n is a, c, g, or t
atcgactccnatgngaggccctgcgccattgcgttggaacccgcgaattcggccattatggccggggctcttccggggacgttgtcttnaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293911 - DNA, 1016 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaaaaattcgaaatagtctcgctctctctctcgcaagagggggggtgaaaaagtggagaacggccagatactaaagagaagaaacccgaagccaagaagggtggatgcggggggcacgggtgcacacaggggtaccctcaaagctaaaaagcccaagaggggaagccccatggagccgcaaccctgtcctggtcagaggactgggaggtatccccgatctgccatgtatccaagaaggcatgtcacagaggaagtactcaggcgtaaatccagggtggaacaccgacacggagggaaggttctcgcaactgtaccaaaacccggtgcgcgtgacacgaccgctggacccgggggggtaacttcgcaaatggctagatttatccactgaaaatggctcgaagctgttgacccggaaaaacctagcacgcgtgaaaaggcggccgatacccggacatggaatctccggagcaggcaaagggggtccgaacaggagggaaatg

SEQ ID NO: 293912 - DNA, 761 bp, Homo sapiens
  misc_feature (566)..(566): n is a, c, g, or t
  misc_feature (575)..(575): n is a, c, g, or t
  misc_feature (580)..(580): n is a, c, g, or t
  misc_feature (584)..(584): n is a, c, g, or t
  misc_feature (597)..(597): n is a, c, g, or t
  misc_feature (602)..(602): n is a, c, g, or t
  misc_feature (605)..(605): n is a, c, g, or t
  misc_feature (610)..(610): n is a, c, g, or t
  misc_feature (613)..(613): n is a, c, g, or t
  misc_feature (619)..(619): n is a, c, g, or t
  misc_feature (621)..(621): n is a, c, g, or t
  misc_feature (623)..(623): n is a, c, g, or t
  misc_feature (631)..(631): n is a, c, g, or t
  misc_feature (642)..(642): n is a, c, g, or t
  misc_feature (645)..(645): n is a, c, g, or t
  misc_feature (653)..(654): n is a, c, g, or t
  misc_feature (665)..(665): n is a, c, g, or t
  misc_feature (670)..(671): n is a, c, g, or t
  misc_feature (675)..(675): n is a, c, g, or t
  misc_feature (682)..(682): n is a, c, g, or t
  misc_feature (684)..(684): n is a, c, g, or t
  misc_feature (692)..(692): n is a, c, g, or t
  misc_feature (723)..(724): n is a, c, g, or t
  misc_feature (738)..(738): n is a, c, g, or t
  misc_feature (741)..(741): n is a, c, g, or t
  misc_feature (745)..(745): n is a, c, g, or t
  misc_feature (747)..(747): n is a, c, g, or t
  misc_feature (754)..(754): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaaaaattgtggcgcggcgcgcgcctccgggccctcggagaaaggttttnataaacccnttcgngtgngggccgccggggncccangtnagggnaangtagancntngggccaanacggtggtccncanagggaganncccggggccangagannaggnggcgggngnttctcccncccaaatataaaaaaaggcgccggggggggnnaaccccgagagcgngtntctntngaacaanatcctcc

SEQ ID NO: 293913 - DNA, 648 bp, Homo sapiens
  misc_feature (605)..(605): n is a, c, g, or t
  misc_feature (608)..(609): n is a, c, g, or t
  misc_feature (613)..(613): n is a, c, g, or t
  misc_feature (617)..(618): n is a, c, g, or t
  misc_feature (631)..(631): n is a, c, g, or t
  misc_feature (636)..(636): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaaaaaaaaaaaaaaaaaaaaaaaaaaaaaaaaaaaacaaaaaaaaaaaaggggggggggcgctaaaaattctccccggggggggcgcncanntttngggnnccccgtttttttntaaangggggggcccca

SEQ ID NO: 293914 - DNA, 1020 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaaaaaaaaaaaaaaaaaaaaaaaaaaaacaaaaaaaaaaaaaaaaaaaaaaaaaaaaaaacaaaaaaaaaaaaaaaaaaaaaaaaaaaaaaaaaaaattttggggggggcccgggccccaaattccccttttggggggcgttttaaaaatcaatgggccgttttttaaaaacttaggattgggaaaaacctggggttacccaaattaattgccttggaaaaaaatccctttttcccaagtggggttaatcgaaaaagggcccgaccaattggcttttccaaaaattggcccaccttaaagggaaatggcaaatttgaagggttaaatttttggtaaaaatcggcgtaaaattttggtaaaacaccttattttttaaccaattgggccaaattgggaaaattcctttttaatcaaaaaaattcccccaaaatggggtaaatggttttccacttttggaacaaagacccctttttaaaaaacgtggcttcaaaccttaaggggga

SEQ ID NO: 293915 - DNA, 1252 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaatccagttctctatgtgaccagttctctgtatgaatggaagggaaaagaattaaaaatcttgcaaaggggaaagttccatcttcttaaaaactagatgtggtaaacaactattctaaaccaggagtagaaaagctaacactatctggctggacacggtggctcacacctgtaatcccagcactttgggaggccaaggtgggtggatcatgaggtcaggagatggagaccatcctagctaacacagtgaaaccccgtctctactaaaaatacaaaaaattagccgggcatggtggcaggcgcctgtagtcacagctacccggaggctgaggcagaagaatggcgtgaacctgggaggt

SEQ ID NO: 293916 - DNA, 506 bp, Homo sapiens
ccctagaggatccccgcatgtttacgacgacatatgtggtggtcaaacatgcgcgtgtttcacgacgacgtatgtcgtcgtcaaacatgcccacgacgtacacatttagcacacatggaaccaccataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293917 - DNA, 1137 bp, Homo sapiens
  misc_feature (556)..(556): n is a, c, g, or t
  misc_feature (610)..(610): n is a, c, g, or t
  misc_feature (644)..(644): n is a, c, g, or t
  misc_feature (676)..(676): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaacaaaaaaaaaaaaaaaaaaaaaaaaaaaaaaacccgggggctttntttgggggggggggaaaaaggggtattgagaatgggcgcccgtggcgccaaaangctgtgtttcccgtggacccagttttccttggtnccaagcggggcgaaatctgcgcgggtcccccntatagagggagcccggaaataaatttccggaataacccagggttaccctgcttttataaatctacgcggcaaacacacgaggacacaccgactaacgagacagactctgtaacgtgaacacacaaggacatactaggcaacaacactaagcagcaagagaaaaaaatgggagcgataccaaaaaaaagaaaacacgcgcgacacaagaaggagtgattatggtgagcgaccagaaacaaagcaaaaaacacataaaccgaaagaaaaaggggccaaacaccaacgcaagatacacaaaaaaagcgacaacacgaaggccaccaagaaacagcgccaacaagtaacagagccgtgtgagccacgcaaaatacccgagcaggaaactcgacgaggagacaaggggagaaagaagagatccgggacgacaccaaacagcaaggaaagagcaaagaaaaacacgg

SEQ ID NO: 293918 - DNA, 1121 bp, Homo sapiens
  misc_feature (540)..(540): n is a, c, g, or t
  misc_feature (594)..(594): n is a, c, g, or t
  misc_feature (628)..(628): n is a, c, g, or t
  misc_feature (660)..(660): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaacaaaaaaaaaaaaaaaaaaaacccgggggctttntttgggggggggggaaaaaggggtattgagaatgggcgcccgtggcgccaaaangctgtgtttcccgtggacccagttttccttggtnccaagcggggcgaaatctgcgcgggtcccccntatagagggagcccggaaataaatttccggaataacccagggttaccctgcttttataaatctacgcggcaaacacacgaggacacaccgactaacgagacagactctgtaacgtgaacacacaaggacatactaggcaacaacactaagcagcaagagaaaaaaatgggagcgataccaaaaaaaagaaaacacgcgcgacacaagaaggagtgattatggtgagcgaccagaaacaaagcaaaaaacacataaaccgaaagaaaaaggggccaaacaccaacgcaagatacacaaaaaaagcgacaacacgaaggccaccaagaaacagcgccaacaagtaacagagccgtgtgagccacgcaaaatacccgagcaggaaactcgacgaggagacaaggggagaaagaagagatccgggacgacaccaaacagcaaggaaagagcaaagaaaaacacgg

SEQ ID NO: 293919 - DNA, 894 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattg

SEQ ID NO: 293920 - DNA, 1128 bp, Homo sapiens
  misc_feature (547)..(547): n is a, c, g, or t
  misc_feature (601)..(601): n is a, c, g, or t
  misc_feature (635)..(635): n is a, c, g, or t
  misc_feature (667)..(667): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaacaaaaaaaaaaaaaacccgggggctttntttgggggggggggaaaaaggggtattgagaatgggcgcccgtggcgccaaaangctgtgtttcccgtggacccagttttccttggtnccaagcggggcgaaatctgcgcgggtcccccntatagagggagcccggaaataaatttccggaataacccagggttaccctgcttttataaatctacgcggcaaacacacgaggacacaccgactaacgagacagactctgtaacgtgaacacacaaggacatactaggcaacaacactaagcagcaagagaaaaaaatgggagcgataccaaaaaaaagaaaacacgcgcgacacaagaaggagtgattatggtgagcgaccagaaacaaagcaaaaaacacataaaccgaaagaaaaaggggccaaacaccaacgcaagatacacaaaaaaagcgacaacacgaaggccaccaagaaacagcgccaacaagtaacagagccgtgtgagccacgcaaaatacccgagcaggaaactcgacgaggagacaaggggagaaagaagagatccgggacgacaccaaacagcaaggaaagagcaaagaaaaacacgg

SEQ ID NO: 293921 - DNA, 546 bp, Homo sapiens
  misc_feature (543)..(543): n is a, c, g, or t
  misc_feature (545)..(545): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaagtcgaccggccggaatttagtagtagtagngna

SEQ ID NO: 293922 - DNA, 529 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtactgtgtatgactttttttttttctg

SEQ ID NO: 293923 - DNA, 833 bp, Homo sapiens
  misc_feature (540)..(540): n is a, c, g, or t
  misc_feature (543)..(544): n is a, c, g, or t
  misc_feature (547)..(547): n is a, c, g, or t
  misc_feature (557)..(557): n is a, c, g, or t
  misc_feature (566)..(566): n is a, c, g, or t
  misc_feature (583)..(583): n is a, c, g, or t
  misc_feature (627)..(628): n is a, c, g, or t
  misc_feature (631)..(631): n is a, c, g, or t
  misc_feature (642)..(642): n is a, c, g, or t
  misc_feature (662)..(662): n is a, c, g, or t
  misc_feature (669)..(669): n is a, c, g, or t
  misc_feature (693)..(693): n is a, c, g, or t
  misc_feature (716)..(718): n is a, c, g, or t
  misc_feature (723)..(723): n is a, c, g, or t
  misc_feature (726)..(727): n is a, c, g, or t
  misc_feature (734)..(734): n is a, c, g, or t
  misc_feature (736)..(736): n is a, c, g, or t
  misc_feature (740)..(740): n is a, c, g, or t
  misc_feature (753)..(753): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaacaactgagactagttctctccnganntcnccgcctcggngggctgggntcggcggtgggagcttnacccctactgggggtcccgctgctggcagcgctggaaactgggnnggncggcatgggtnggtctcaggatttgttccgngccttgnggagatcgctgtcaagggaagtgnaagagccgttggccggaccattnnnggacnatnntactacncncgcngtacagactgggnggcacctgtcggagaaaaatgtgaaccgcataaaggatgcctgagcggttcccgaggagcggttagaagaaccccagggg

SEQ ID NO: 293924 - DNA, 610 bp, Homo sapiens
  misc_feature (558)..(559): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtacataccgacgtaggctttcctacatacagcctctaacaaactaggctgtcccannccctggtaatagaattgtttacctttataccagaaggttgggaagcaccaa

SEQ ID NO: 293925 - DNA, 661 bp, Homo sapiens
  misc_feature (618)..(618): n is a, c, g, or t
  misc_feature (621)..(622): n is a, c, g, or t
  misc_feature (626)..(626): n is a, c, g, or t
  misc_feature (630)..(631): n is a, c, g, or t
  misc_feature (644)..(644): n is a, c, g, or t
  misc_feature (649)..(649): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaacaaaataaaaataaaaaaattttatcaaaaaaaaaaaaaaaaaaaaaaaaaaaaaaaaaaattggggggggggcgctaaaaattctccccggggggggcgcncanntttngggnnccccgtttttttntaaangggggggcccca

SEQ ID NO: 293926 - DNA, 668 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtacctatatttatatttttatattatatattttattatttctataattttcctatatcttcataacccttatatttattttctcttactctacattctatcatttactcattattattacttttatatatcttatattcatttattttcttcttctcttcccttcc

SEQ ID NO: 293927 - DNA, 546 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaccaaataccacctcttaatttcctttctctaacacttctact

SEQ ID NO: 293928 - DNA, 540 bp, Homo sapiens
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaagtcgacgccgcaatagtatagtagc

SEQ ID NO: 293929 - DNA, 573 bp, Homo sapiens
  misc_feature (530)..(530): n is a, c, g, or t
  misc_feature (532)..(533): n is a, c, g, or t
  misc_feature (535)..(536): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtattttcatttttattactcaaaaaagntnnanntgcgtatttagctttctgactctgtgcttgtcgacgc

SEQ ID NO: 293930 - DNA, 1168 bp, Homo sapiens
  misc_feature (587)..(587): n is a, c, g, or t
  misc_feature (641)..(641): n is a, c, g, or t
  misc_feature (675)..(675): n is a, c, g, or t
  misc_feature (707)..(707): n is a, c, g, or t
cctcttccggggacgttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaacaaaaaaaaaaaaaacccgggggctttntttgggggggggggaaaaaggggtattgagaatgggcgcccgtggcgccaaaangctgtgtttcccgtggacccagttttccttggtnccaagcggggcgaaatctgcgcgggtcccccntatagagggagcccggaaataaatttccggaataacccagggttaccctgcttttataaatctacgcggcaaacacacgaggacacaccgactaacgagacagactctgtaacgtgaacacacaaggacatactaggcaacaacactaagcagcaagagaaaaaaatgggagcgataccaaaaaaaagaaaacacgcgcgacacaagaaggagtgattatggtgagcgaccagaaacaaagcaaaaaacacataaaccgaaagaaaaaggggccaaacaccaacgcaagatacacaaaaaaagcgacaacacgaaggccaccaagaaacagcgccaacaagtaacagagccgtgtgagccacgcaaaatacccgagcaggaaactcgacgaggagacaaggggagaaagaagagatccgggacgacaccaaacagcaaggaaagagcaaagaaaaacacgg

SEQ ID NO: 293931 - DNA, 934 bp, Homo sapiens
cctcttccggggacgttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattg

SEQ ID NO: 293932 - DNA, 1525 bp, Homo sapiens
cctcttccggggacgttgtctgcaggtatggatgttgttctcttttccctgtctttatttccttaccaatcggctgccatccgaggagctgaggaagcctagagctctcagaagcagtcctttgagctggtgtaggggtaaggggcacaacagggaggttggtggtgaggaagttccttactttgatctttggaaatcccttgttcctggtggcacctccaaagccgtgagtagccacagctcaccacccgggactttgctgcattccaagtgtagcgtttggagactaacgagttgtggtttggcggtttgagtctggaaaatcgccaaacgttttcatattttacacccacgttttcacagcacgcctgcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaatccagttctctatgtgaccagttctctgtatgaatggaagggaaaagaattaaaaatcttgcaaaggggaaagttccatcttcttaaaaactagatgtggtaaacaactattctaaaccaggagtagaaaagctaacactatctggctggacacggtggctcacacctgtaatcccagcactttgggaggccaaggtgggtggatcatgaggtcaggagatggagaccatcctagctaacacagtgaaaccccgtctctactaaaaatacaaaaaattagccgggcatggtggcaggcgcctgtagtcacagctacccggaggctgaggcagaagaatggcgtgaacctgggaggt

SEQ ID NO: 293933 - DNA, 613 bp, Homo sapiens
  misc_feature (545)..(546): n is a, c, g, or t
cctcttccggggacgttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtannaaaaaaaaatatctttcactttaaaattaaataattctttctacggccgaatttgggcttacttggc

SEQ ID NO: 293934 - DNA, 785 bp, Homo sapiens
  misc_feature (492)..(492): n is a, c, g, or t
  misc_feature (495)..(496): n is a, c, g, or t
  misc_feature (499)..(499): n is a, c, g, or t
  misc_feature (509)..(509): n is a, c, g, or t
  misc_feature (518)..(518): n is a, c, g, or t
  misc_feature (535)..(535): n is a, c, g, or t
  misc_feature (579)..(580): n is a, c, g, or t
  misc_feature (583)..(583): n is a, c, g, or t
  misc_feature (594)..(594): n is a, c, g, or t
  misc_feature (614)..(614): n is a, c, g, or t
  misc_feature (621)..(621): n is a, c, g, or t
  misc_feature (645)..(645): n is a, c, g, or t
  misc_feature (668)..(670): n is a, c, g, or t
  misc_feature (675)..(675): n is a, c, g, or t
  misc_feature (678)..(679): n is a, c, g, or t
  misc_feature (686)..(686): n is a, c, g, or t
  misc_feature (688)..(688): n is a, c, g, or t
  misc_feature (692)..(692): n is a, c, g, or t
  misc_feature (705)..(705): n is a, c, g, or t
tcgggtacccacacgttacgccttcctctcccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaacaactgagactagttctctccnganntcnccgcctcggngggctgggntcggcggtgggagcttnacccctactgggggtcccgctgctggcagcgctggaaactgggnnggncggcatgggtnggtctcaggatttgttccgngccttgnggagatcgctgtcaagggaagtgnaagagccgttggccggaccattnnnggacnatnntactacncncgcngtacagactgggnggcacctgtcggagaaaaatgtgaaccgcataaaggatgcctgagcggttcccgaggagcggttagaagaaccccagggg

SEQ ID NO: 293935 - DNA, 515 bp, Homo sapiens
  misc_feature (472)..(472): n is a, c, g, or t
  misc_feature (474)..(475): n is a, c, g, or t
  misc_feature (477)..(478): n is a, c, g, or t
tttgatccccctttgaaacgttccgcgcgcctttgagatgaccactccgaaatctcggccattatggccggggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcttttcatttttattactcaaaaaagntnnanntgcgtatttagctttctgactctgtgcttgtcgacgc

SEQ ID NO: 293936 - DNA, 531 bp, Homo sapiens
cgctccaagtttttacgctagtatatcctttctcttccatttctccaccagtaataatggcaaaaatgggacaataaactcattcatgataatcaaaccattgtttacttctcgatcctctccagattcgaagagttctgcggcttgctccatttaattttagcaaacattctcttctataatgtgatatcaattcttcatcagcggtaaaagcttaagcttttaccgcatacataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293937 - DNA, 1131 bp, Homo sapiens
gcggccgcctactactactactactgctcgaattcaagcttctaacgatgtacggggacatgtgtgctaaatgtgttcgtgacagataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaatccagttctctatgtgaccagttctctgtatgaatggaagggaaaagaattaaaaatcttgcaaaggggaaagttccatcttcttaaaaactagatgtggtaaacaactattctaaaccaggagtagaaaagctaacactatctggctggacacggtggctcacacctgtaatcccagcactttgggaggccaaggtgggtggatcatgaggtcaggagatggagaccatcctagctaacacagtgaaaccccgtctctactaaaaatacaaaaaattagccgggcatggtggcaggcgcctgtagtcacagctacccggaggctgaggcagaagaatggcgtgaacctgggaggt

SEQ ID NO: 293938 - DNA, 1238 bp, Homo sapiens
  misc_feature (328)..(328): n is a, c, g, or t
  misc_feature (368)..(368): n is a, c, g, or t
  misc_feature (385)..(385): n is a, c, g, or t
tgatgttactctattcttaatttaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacagatcaagcgtgctttcctttaatcgnaaggggggggaaaagggggcccccccccaaaaggggggcntaaaataaaacaaacanaaatttttttccccttgtgaaagtgttgaaggcacaagcacagagtcagaaagctaaataaaaaaatgaaacttttttgagtaataaaaatgaaaagacgctgtagtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaatccagttctctatgtgaccagttctctgtatgaatggaagggaaaagaattaaaaatcttgcaaaggggaaagttccatcttcttaaaaactagatgtggtaaacaactattctaaaccaggagtagaaaagctaacactatctggctggacacggtggctcacacctgtaatcccagcactttgggaggccaaggtgggtggatcatgaggtcaggagatggagaccatcctagctaacacagtgaaaccccgtctctactaaaaatacaaaaaattagccgggcatggtggcaggcgcctgtagtcacagctacccggaggctgaggcagaagaatggcgtgaacctgggaggt

SEQ ID NO: 293939 - DNA, 488 bp, Homo sapiens
ccggccgcgtcgacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgagggtcgtgctgtaagacctaaagtctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293940 - DNA, 827 bp, Homo sapiens
  misc_feature (117)..(117): n is a, c, g, or t
  misc_feature (798)..(798): n is a, c, g, or t
cactgggtgtgaaacaactaattgtcggtgttaacaaaatggattccactgagccaccctacagccagaagagatatgaggaaatgttaaggaagtcagcacttacattaagaaaantggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaatctgtcgaaatgcaccatgaagctttgagtgaagctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacagatcactgcttccttatcnaagaaccaaaaaccctgttaaatttttta

SEQ ID NO: 293941 - DNA, 326 bp, Homo sapiens
  misc_feature (85)..(85): n is a, c, g, or t
atgtggtgtgtgcccaggcagcccctggtaatagaattgtttacctttataccaagggctgcctgggcacacaccacatgcaganttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgta

SEQ ID NO: 293942 - DNA, 457 bp, Homo sapiens
ctctacagagttgttggacggaaagaggagagtgggcccacttctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccgcctgctactgagtaaggggcattcctgttacagaccaaggagaactggagaaagaaagagaaaatcagttcgtggttgcattgtggatgcaaatctgagcgtctcaacttggttattgtaaaaaaaggagagaaggatattcctggactgactgatactacagtgcctcgccgcc

SEQ ID NO: 293943 - DNA, 730 bp, Homo sapiens
gcggccgcctactactactactactgctcgaattcaagcttctaacgatgtacggggacatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaaaaaaaaaaaaaaaaaaaaaaaaaaaaacaaaaaaaaaaaaaaaaaaaaaaaaaaaaaaacaaaaaaaaaaaaaaaaaaaaaaaaaaaaaaaaaaaattttggggggggcccgggccccaaattccccttttggggggcgttttaaaaatcaatgggccgttttttaaaaacttaggattgggaaaaacctggggttacccaaattaattgccttggaaaaaaatccctttttcccaagtggggttaatcgaaaaagggcccgaccaattggcttttccaaaaattggcccaccttaaagggaaatggcaaatttgaagggttaaatttttggtaaaaatcggcgtaaaattttggtaaaacaccttattttttaaccaattgggccaaattgggaaaattcctttttaatcaaaaaaattcccccaaaatggggtaaatggttttccacttttggaacaaagacccctttttaaaaaacgtggcttcaaaccttaaggggga

SEQ ID NO: 293944 - DNA, 676 bp, Homo sapiens
gcggccgcctactactactacaaaattcgcggccgcgtcgacggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaaaaaaacaactgagactagttctcttcttctctcttctcgactctccgggcccaattatgacgagcgggctcggaaaaaccgagaggagctagacaagttactgggtcctccagcgagtatttggggggagagccacccacagtgggtccccacacagtctggctgagtgttgggagcttgctgagacgacgctcacagagctggagacgtacagtccagtccttgggagatcgacctgggactccatgagaatatctgagggccaagcttgggagaacagcctgagggaggtggatggcccgttacgccctacagtttggagcagctcaaggggatcctggtgccccttgagtcagagctgggcacagacccgggcagagggactgcgccaggcccaggatatgaggccctgttgaacatcagggtcaagctggaaggctgagattcgcacctaccggcgc

SEQ ID NO: 293945 - DNA, 448 bp, Homo sapiens
ttatgttttacgttgggtagttcccttaacgaagttgctcgtatgcatatctgtataaccgatttgctaaataacatcacgatgtttccagaagtgggaagaaagcaggtgccataacccaaagaaacttgtgtaatatcaaaattagtattaaagggtatgcctttacgcaggtggtgctttagggcaagacattgaaccctgatatgtgccaggcattgtgttgggacggatagcccacgtcgtttaatcctaatgacagctgtataaagtagacagaattcccatgttagagataaggaggctagctccttgccctttatattcccagtaaatggcatagctaaggattcgacttcagagctcactttttgtgctctttgtttaaagcggtgtttctccaactgggctcgtggcacttttctggacaccactccaaacaaaatta

SEQ ID NO: 293946 - DNA, 523 bp, Homo sapiens
gcgagtcgagagtagaggaaacccaattcggcccgggcaatgtcagccatctctgttttttaaagggcttattgaaaaatgacatgtatttattcagaaatcttgagttttgtggacaaatttttctgcttctcagagggaagctaaatctttccctagggtggaaagaagagagacttctattcagaatttgattcccagagaatttgaagttgtagaaatgagaatttaaccttgccagaataaaagttattgaggggaaaggaggatttatagaaagtgtaaaaggaatggaatgacttagagtaggtagtccctacattctagaggtgacttttctgctctttaactcaagggtgaagaacctgatacatatttgattgtttttccatgttagacaataggaaaaactgctgaatggctgggtaaagaagcaagaagtgatgtgcaaatataaatcaaaactgggacaagagggcatggctgtgtttttggactgaaagagtatctgtttcaggtgtgg

SEQ ID NO: 293947 - DNA, 882 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattt

SEQ ID NO: 293948 - DNA, 917 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttccaaaagaaaataaagagaaacgtctccaagcctt

SEQ ID NO: 293949 - DNA, 867 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggttcatctctcagtacttcccacctgtggcctgtatcacagccatcccaaacaactgtgcccagaatccatcaagctgtctcattccttcatgccacatgtgtatatgtggctggctttgcccttcccacccccatcgccatctgcctggccaactcagaacttccagattcagttcaaatgttgctctttctccatgaagtcccaggcagaaacaaccaccctatctttcagatttatgaaaggtctctgttagaatttgtagtttcattccccttttattgctcatcaaatgtatttctgatcttggaattggatgaactt

SEQ ID NO: 293950 - DNA, 624 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggaggaccgagagcgagcggacagctgctagctggaccctagacagaccccctctaccaaagctctcaatggagccgagcc

SEQ ID NO: 293951 - DNA, 888 bp, Homo sapiens
  misc_feature (26)..(27): n is a, c, g, or t
  misc_feature (860)..(860): n is a, c, g, or t
cggcacgagggagcaccgaaagggcnntggctttgcgacgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttaaaaaaaaaaatgagggttttgcggggcggaaagagttggagggctggataggttctgcccttttggcnaggaatgcgcccaagggggtaatgaacg

SEQ ID NO: 293952 - DNA, 942 bp, Homo sapiens
  misc_feature (942)..(942): n is a, c, g, or t
taattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggagtccatgggtggactgggagcgacgcacaggatccggaaccgtggtgttctcgctgacacggggggccccggaatcaggccagccaaatacctggttcaaccccacctgtcccagcatgttgccccgctaatgcttgagcccacgggcacatggttttgccccccaaggttgaacgcgggaataactcgggacacctggggggtttacaagagaaaaggcactccccctcgcgttaggttagaaaaagaaan

SEQ ID NO: 293953 - DNA, 985 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggcaggataattgcatgaacctgggagaggcagaggttgcagtgagccaagatcatgccattgcactccagcctgggcgacagagcaagactccatctcaaaaataaataaataaataaatagattaaataaataaaaaaatccactgtgcaaaaagggaacacagccttctcctgtagagacaagttttctgagtggggactcagctcccctggggcatcagagcacactactctcagccttgcaggagggagggtgcctctcgcttgttagaacttttctttccttggctgggtgtggtggctcatgcctgtaatcccagcactttaggaggctgaggcgggtagatagctttagaccaggagttcaaggccagcctgggcagcatggcaaagacccatctctacaaaaacataaaaattagctgggtgtggtggccaggtgcctgtagtccacagcttctcaggaggctgaggcaggagaatcgcttgaacctgggaggcagaggttgcagcagagaccaagattgtacccactgggactccaagtaagggtgaccacagtaagaactctcatctacagagaaaaaaaacaagggcggcaacgccaccgacgaggaaggccaacagaaggggagacacaacggcatgaagcgcggaaagacaaaacagctacgagcgaaaccaaagagaggacccaaaaataagacgaaacacgcgaaaacaaatgagacacgagggaccagcggccagcgagcgcagtgagcaagacgaaggagaagcacgcggacaagaacagcaggataacacacgcggaagatcaatagtagacaagaacactg

SEQ ID NO: 293954 - DNA, 979 bp, Homo sapiens
  misc_feature (951)..(951): n is a, c, g, or t
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttaaaaaaaaaaatgagggttttgcggggcggaaagagttggagggctggataggttctgcccttttggcnaggaatgcgcccaagggggtaatgaacg

SEQ ID NO: 293955 - DNA, 1026 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttcacccatgtctattccctatttgttggtggggcccagaggagtccagcatcttcttttgggctttaggaagagggcactcaagggacatcagccacacctaattggctaggtgggccagagttagggaaggccagggcatccct

SEQ ID NO: 293956 - DNA, 791 bp, Homo sapiens
  misc_feature (26)..(27): n is a, c, g, or t
cggcacgagggagcaccgaaagggcnntggctttgcgacgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattt

SEQ ID NO: 293957 - DNA, 797 bp, Homo sapiens
  misc_feature (26)..(27): n is a, c, g, or t
cggcacgagggagcaccgaaagggcnntggctttgcgacgatgaagacactgaggctcagagaggttaagtgactcagccaaggtcaaacagctatctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagaggcctgtagggcttacaggctctgtcctgcccaccagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattt

SEQ ID NO: 293958 - DNA, 658 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacggagattccaggccagcccaaactaccctgcatcccaacccccaaccctctgcacttgaaatccccagggcctgaaacctactccaccttcctggccagtacctcaccccttgattgccaggtctggtctaagtttctttaataaagacaaaggagtgattt

SEQ ID NO: 293959 - DNA, 613 bp, Homo sapiens
gggggggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagtacctcaccccttgattgccaggtctggtctaagtttctttaataaagacaaaggagtgatttcacccatgtctattccctatttgttggtggggcccagaggagtccagcatcttcttttgggctttaggaagagggcactcaagggacatcagccacacctaattggctaggtgggccagagttagggaaggccagggcatccct

SEQ ID NO: 293960 - DNA, 566 bp, Homo sapiens
atttctgtctgagacccgccctgctttctttctgttggtcaactgcatggtcattatcgtaatgagcaaagaaagggcggtggctttgcgacggtgggttgggctttcggagccgagatcgctggtctgtcagtacttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatgttagttcatccattcaatcttccatctacttatttatccacttattcatgcctcctagaatgtcttactgaaccctgcttgcatatgctacaatccctccaccccgacatttggctgtgatt

SEQ ID NO: 293961 - DNA, 663 bp, Homo sapiens
actcagccaaggtcaaacagctagtaagtggtggagccaggactcaaagccaggtctgtctgattcctagggggaggggctgctttcctgctgtcttccaccctatccctaaatcaaattacaaccaaattaaaaacaaaaacaaagcaaaacacattcacttgaccctttccctcagttctaggagccatgtccactttgttcccctcactcttccctcgtgtgactgagactctgtggtttaatctggatcgaccctgtgtggaagagacagagctgcagcagcaggaacagcagcatcaggcctgggtgagtgagcagctagcacagcacagagacctcagcacagacagagacctccttcagtgggccatgacccagccttactccagaaatctacccaggaagagctttttgccctgagctgggaataatcgggctgggagccagggagccaaggttctcatcttgtggtaccctattttacaggggtaccatgtgacttctgggccagattagagcccaggctgctgacactcagcccaagctcttttccctaaagcacaggaaataattttgactattaattgaggatctagcagatgatgctttctaggctgataagtctctcacttcatcctcaccataattatacaaaaaaaa

SEQ ID NO: 293962 - DNA, 177 bp, Homo sapiens
  misc_feature (177)..(177): n is a, c, g, or t
agtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcn

SEQ ID NO: 293963 - DNA, 6336 bp, Homo sapiens
  misc_feature (2113)..(2113): n is a, c, g, or t
ctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctngagaagtcaccctccttcgcctcggagtgggatgagattgagaaaatcatgagttctattggagaagggattgacttttctcaggaacggcagaagatctcaggttcacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccaagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagtttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccgctgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcgcatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatg

SEQ ID NO: 293964 - DNA, 949 bp, Homo sapiens
  misc_feature (908)..(908): n is a, c, g, or t
cctttagacaaagcattctgctgcggctctgtcagcgcgcacatccaccggcagcaggcaggaccacagctgcccggctgggggattacaagcaagaatgaatcagcacccggggacacttgacttcatgggcatagaagaacctgccacgtaggctcctggagcagacttccccattcaagggcaggggagctcaagtatcccccagactcggcatcttggagcgctgcggcagcgtgcatccagaaggccgccgggtccctgaccatcatctgttctgcaggagacagaggagagggagtggaggctggcagagttggtcaccagggtcttgtagataaccaaggaagttggcattgtcctgccccaaggggcagaaagtacctgggaacggcagaatgactttcaccgtgtcaggagttcactggaggttcacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgcaaagattnctctccagacgtattccactgagtagaataatctgcatggg

SEQ ID NO: 293965 - DNA, 2926 bp, Homo sapiens
ccccacctgcactgggacctgctcctcttgggcgggcggtacacttgcagctctcgcacctaccaccaccgaacactgtgaattctcccccttgggctgaggacagcttgagggggtgagttgcctttgagctgagccactgaggaaccacactgtgctgcggaaacatagacgtgggggcataggctcccgctgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcgcatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatg

SEQ ID NO: 293966 - DNA, 5862 bp, Homo sapiens
  misc_feature (2113)..(2113): n is a, c, g, or t
ctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctngagaagtcaccctccttcgcctcggagtgggatgagattgagaaaatcatgagttctattggagaagggattgacttttctcaggaacggcagaagatctcaggttcacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccaagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagtttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccgctgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccttgaccaggaaccctaaagcatccagagtagactgcgctgccactgcgcgcatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatg

SEQ ID NO: 293967 - DNA, 1899 bp, Homo sapiens
ttaggctaggtagaggcccgggtgtgatcggcgaggcacctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcgcatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatg

SEQ ID NO: 293968 - DNA, 470 bp, Homo sapiens
tgagcagagtcactgagccagaggcagtgggggctgcaggctgtgggtgctcaaagcaggcatggagggtgccccggggaggctgtgagggatcgtctgtcctgctctgtgtttcctttccatttcctccaccgtccgcaggccccattggttaaccctttcctccccccattgtttgcttctgccaagctgagccactgaggaaccacactgtgctgcggaaacatagacgtgggggcataggctcccgctgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaaca

SEQ ID NO: 293969 - DNA, 2104 bp, Homo sapiens
tccagcctcccaaagtgctgggattgcaggcatgagccactgctcccggccctattatccatagttctaatccacagggattacagcataatgctagcagggccaggttcatccttgagacagtgtggctggctgtcacctggtcctccctttaccagccagccccattgcacactgtgcagcccatcccctcccagaaatagagtgacaaactctgcacttaagtcccctgtttctgtttaacttgcagtgcttatcacaggcccttccttaattttttaaacaaggctgcttgaggctggggtaaattttggggctttgggagtacacaggactactgagggacggggagttggtggcttggtgttcatggtggagacttggttctttacgcagagcaggctaaaggcgtgttttttctgctctgtttctaattcatgttaagtagttggtcatcactttggtcagagctgctgctgaagctctcttaactgtgagtcactggacgttggcagggagttggctgtgagattgtaggtgctcaagtgtttctgttcgggactgagtgtgaatctgtaaaaggggaaaatcctcgcaagaggtctacgagaaggttgagggcccaagtctagggtctaaacaaagccaggagtggtttggtatattactgagtgcaatcattgcgtgccattcctgcactcaatgtattgtgtaaaatccttaggtaaaatgggataaacccacagctggtcctacttggcctcttgaaaaccattccatcattgtgccaatctagcctgaaaaggaaaaaaaaaagggaaaccattgattgtctcttgcctcggaggttgggggtatgcccctactccaggctttgcagtgatcatatgatgcagtaatgaagatctggggcctggcacaacactttgggatccacccaaggcgggtggatcacttgacctcaggagttggagaccagcctgggcaacacggcaaaaccccatctctacaaaaatcacaaaaattagccgggtgtggcaagtgcctgtagtcccagctactcaggaggctaaggtgggagaatcgcttgagcctgagaggtcgtggttgcagtgagctgcgatcctgccactgcattccagcctgggctacaaagctagaccctatctcaaaaaaaaaaaaaaaaagaaaaagaaaaaaaagatttgagcccaatctggttcagacctgtttggctcagtgagcctggacttgggggaaggggatatgtactttttaaaagaacatttattgttactatgtttcatatttagaaaacaggacagagacttttttctggaaaaacaaaactgcagcaagtggagtttcttttttctggaaaaacaaactgcacgaagtggagtttagcaaaatgttctgaaactagtgcttctcaaccagtaaagcaggcacgacagaaacagtggggcaagggctttttgttctagtgaaacaggtggcctcctttcgatgtgggtttgtaaagcactagtggtctaatagcatgggctccttgagatagacctctgaagtttgttttctcagtcaagatcccagccaggaacgttccctgtgagcccccgaatctggggtacatagaaaattccagaaggttcagactgggggtgggtccagactaaggtaaacttctgggacattccatgaaactctaagcaaagtattctataaggtttactaaccatcatccaatcctaagcctctcccctgactcagcacaaggcctactccgtaatgtcatccctttatgcctcagggttttgtaggccagagctaatgcctgagggaccccactccctgcctgccctgaaactgagcctgtgctcttcatggaaaggaaaatgtgtgggaggctttttgaaggacccccaaaaggttcccatggtcacattttccccccacccactcagattggcttgagtcttttctttctctgctgctacctggcaagtggaggctgaactcggccatgaccttagcccctgccttctaggggctattccataattcctggttgtggaggatggctcagacatgcccagcctta

SEQ ID NO: 293970 - DNA, 2471 bp, Homo sapiens
ttctcttgcaccgcctgccgaatcaattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaacttgtctttctgtgacttccccaagccgcaggtgagacctggtccagggtaagaatgggatcggtggagagcctgtcgttcctcccgctaaggtcagccccctggggcactcctccttatgttgatagcatgtaggagtgagaaaaagtcattgagcataaggaatgagtgttcctgtgcccatatttaatgtgtgaccttggagaagttactctgtaggcatgacagcagaggagaaaatcatttggcatcttgaggtctgtcatgctttattatccatagtttttggggggttttttgttttgttttgtttttgagatggagtctgggctacaaagctagaccctatctcaaaaaaaaaaaaaaaaagaaaaagaaaaaaaagatttgagcccaatctggttcagacctgtttggctcagtgagcctggacttgggggaaggggatatgtactttttaaaagaacatttattgttactatgtttcatatttagaaaacaggacagagacttttttctggaaaaacaaaactgcagcaagtggagtttcttttttctggaaaaacaaactgcacgaagtggagtttagcaaaatgttctgaaactagtgcttctcaaccagtaaagcaggcacgacagaaacagtggggcaagggctttttgttctagtgaaacaggtggcctcctttcgatgtgggtttgtaaagcactagtggtctaatagcatgggctccttgagatagacctctgaagtttgttttctcagtcaagatcccagccaggaacgttccctgtgagcccccgaatctggggtacatagaaaattccagaaggttcagactgggggtgggtccagactaaggtaaacttctgggacattccatgaaactctaagcaaagtattctataaggtttactaaccatcatccaatcctaagcctctcccctgactcagcacaaggcctactccgtaatgtcatccctttatgcctcagggttttgtaggccagagctaatgcctgagggaccccactccctgcctgccctgaaactgagcctgtgctcttcatggaaaggaaaatgtgtgggaggctttttgaaggacccccaaaaggttcccatggtcacattttccccccacccactcagattggcttgagtcttttctttctctgctgctacctggcaagtggaggctgaactcggccatgaccttagcccctgccttctaggggctattccataattcctggttgtggaggatggctcagacatgcccagcctta

SEQ ID NO: 293971 - DNA, 1625 bp, Homo sapiens
ttctcttgcaccgcctgccgaatcaattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaacttgtctttctgtgacttccccaagccgcaggtgagacctggtccagggtaagaatgggatcggtggagagcctgtcgttcctcccgctaaggtcagccccctggggcactcctccttatgttgatagcatgtaggagtgagaaaaagtcattgagcataaggaatgagtgttcctgtgcccatatttaatgtgtgaccttggagaagttactctgtaggcatgacagcagaggagaaaatcatttggcatcttgaggtctgtcatgctttattatccatagtttttggggggttttttgttttgttttgtttttgagatggagtcttgcgctctgttgcccaggctggagtgcagtggtgcgatcttagctcactgcaacctccacctcccgggttcaagcgattctcctgcctcagcctcctgtgtaactgggattac

SEQ ID NO: 293972 - DNA, 1323 bp, Homo sapiens
  misc_feature (1205)..(1205): n is a, c, g, or t
ttctcttgcaccgcctgccgaatcaattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtaattataataatattaactttttttntatcattcaattatggttatattttaaacaatataatatttatatacccgaggggggggcccggtcccaatatcccccttatagggggtggttataaatttccggggccgtgttttta

SEQ ID NO: 293973 - DNA, 1952 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagac

SEQ ID NO: 293974 - DNA, 2584 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattcctgcagttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatc

SEQ ID NO: 293975 - DNA, 2793 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattcctgcagttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatc

SEQ ID NO: 293976 - DNA, 1799 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagac

SEQ ID NO: 293977 - DNA, 2093 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagtgttttttcctcttcaggtgagccaggaaaacagaagatatttggagccacattggatcagcatcttgctatagatgtctcaagatttgaagttctaaacttgctttactgttggtccccaagagattcaacaggggccatcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagac

SEQ ID NO: 293978 - DNA, 1843 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagatt

SEQ ID NO: 293979 - DNA, 677 bp, Homo sapiens
gatagtgagatacatctatttagtcttctatatagagaccaccgcgcccgcccgcttgcggcggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagac

SEQ ID NO: 293980 - DNA, 1809 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaaactgacaccagagagagtgacttggaacttaaggtgtgttttcttggccggacatagtgcttctgcctgtaatcccagcacttgggtggctgaggcgggcgatcagttgagctcagtagttcgagaccagcttgagcaacatggcaaaaccccatctctacccaaaatacaaaaaattaactgggtgtggtgttgtgtgtgtgtggttccagctactcaggaggctgaggtgggaggatcactcgagcctgggaggcagaaatttcagtgagccaaaattgtgctactgttctccaacctgggtgacagagtgaaaccccatctcaga

SEQ ID NO: 293981 - DNA, 1553 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgacttccccaagagaaaatacctagagattgaaccggatagctgcctaatcctcggagtcacc

SEQ ID NO: 293982 - DNA, 1553 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcagggaaaccggaaaacgagttcagaagttaggacgaactgggagaagcccgatgtgcgaatctggtgcgagaggtaatcagagacatgaggttgaatgggccgtgtataagcgtaaattgtagggatattgaaggtttcccaggaaatttcaaagcgaagttcgcgtgggtatggggaacgacgctattgtagtaggacggttaagtgaggtatttt

SEQ ID NO: 293983 - DNA, 1376 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattcccacagttttaataagaacagatcaggaattctaaataaatttcccagttaaagatt

SEQ ID NO: 293984 - DNA, 1363 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattattttggaaa

SEQ ID NO: 293985 - DNA, 1387 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagtttgtgtgcacttttctgctctagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattattttggaaa

SEQ ID NO: 293986 - DNA, 2759 bp, Homo sapiens
  misc_feature (25)..(25): n is a, c, g, or t
tccggaattcccgggatggcggagnagcggtgcgctcagctcccgggagcggcccgagcagccgagcgcccagggctgcccttcccgggccggcgggctccccgggctccccgccgccgccccgtgcgccccgggagggcccggcatgctgcgccagctgctgctcgccgcgctctgcctggcgggtcccccagcgcccgcgcgcgcctgccagctgccctccgagtggaggcccctgagcgagggctgccgcgccgagctggccgagaccatcgtgtacgccagggtgctggcgctgcaccccgaggcgcccggcctctacaaccacctgccctggcagtaccacgccggccaggggggcctcttctactcggccgaggtcgagatgctgtgcgaccaggcgtggggcagcatgctggaggtgcccgccggctccaggctcaacctcaccggcctgggctacttctcgtgccactcccacaccgtggtccaggactactcctatttcttcttcctcaggatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaacgcccgggggcccgtgcgccccccctacctgcgggggtaacgggcctgggggctgccaggtgtgcagggccaatcctggcggtaattgagaatgagtgaggtttcgtacatgcagctatttcaagggttgtaagagtttttgtttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagacccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccacaacagtgagatga

SEQ ID NO: 293987 - DNA, 1564 bp, Homo sapiens
  misc_feature (25)..(25): n is a, c, g, or t
tccggaattcccgggatggcggagnagcggtgcgctcagctcccgggagcggcccgagcagccgagcgcccagggctgcccttcccgggccggcgggctccccgggctccccgccgccgccccgtgcgccccgggagggcccggcatgctgcgccagctgctgctcgccgcgctctgcctggcgggtcccccagcgcccgcgcgcgcctgccagctgccctccgagtggaggcccctgagcgagggctgccgcgccgagctggccgagaccatcgtgtacgccagggtgctggcgctgcaccccgaggcgcccggcctctacaaccacctgccctggcagtaccacgccggccaggggggcctcttctactcggccgaggtcgagatgctgtgcgaccaggcgtggggcagcatgctggaggtgcccgccggctccaggctcaacctcaccggcctgggctacttctcgtgccactcccacaccgtggtccaggactactcctatttcttcttcctcaggatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaacgcccgggggcccgtgcgccccccctacctgcgggggtaacgggcctgggggctgccaggtgtgcagggccaatcctggcggtaattgagaatgagtgaggtttcgtacatgcagctatttcaagggttgtaagagtttttgtttttaatcacgcatttggtagagtctaaatggataaaatgcaaggcttgctttccccttgggtgctggcctcaattgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccacaacagtgagatga

SEQ ID NO: 293988 - DNA, 4896 bp, Homo sapiens
ccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcaaaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctggagaccacaaacatctgcagactaaacctctcca

SEQ ID NO: 293989 - DNA, 3897 bp, Homo sapiens
ccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcaaaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgagacttctcctcctcctgaagataggaaggaaatttcaccagaggtagagcatataccagaaatagaaattaatatgctgactgttccacatgttcccaaggtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaactta

SEQ ID NO: 293990 - DNA, 1300 bp, Homo sapiens
ccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcaaaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagaagctgtaagtttggggagcatataagtgttcttcagctgttggagttttgcatattctccataaccaaaattttcacagaaaagcaaggcagatattcacgttggtgatatttggttggcctctgtatataacggtgaa

SEQ ID NO: 293991 - DNA, 521 bp, Homo sapiens
caggaagtggctgagagggggagagagttggagagagacggccgcggaggacacggggacgggaaagtctgagagacggggagagcctgacccggcgggacacaggcaaaaagaaacacgcgagccagacagacgcagaagaaacgtgcctggtactggataggaacttcatggaatggagctaatgggccacggctagagttcccagtttggccttttggggcattcatcccatctactttattttcatctgcttgggcagtaatgtaaacaaattaaaggcaagtaaaagtatcaatgtccctctcctaagatttcccttaagctgaagaaaactgtgcccacatgtactgagggaaactaacctcaccccaacccagacttccttcctgaagcccttctttccacatcctctacagcacacaaaaatacaaaaaacaaacaaaatccactaaaaagttccatgtagggatatgccatcatgaaaagcaagctggaaataaagattatgacgctctgta

SEQ ID NO: 293992 - DNA, 449 bp, Homo sapiens
aactggaacggcgagtgtttccccaagtgctgggatcagagcggtgagcactgcgcccagcccctacataaatttcaaacaccacattcccgtgactacaacacatataaatgttagaaatcaacataacgaaaatataactagcaaaattctgtatgtttgaaaattttaaatattttcccagaaactataaaattacacattaatgtggataaatctcaaacaatgttaactgaaataattaaatcacagaagcctgaataatggattcatttacataattaaagaacacattcatagtggtaacactataatgaaatgacaaagattaacacaaaattcaccctagtgtgtacctatgggtaataaggggactgtgaggtagggtgggggaagccaggcgggaatgagtagggaggcactgggaggaggggagaggcaagagttag

SEQ ID NO: 293993 - DNA, 533 bp, Homo sapiens
tcatagggtaggtttcctagaaaagcagtgtagggtggcgatttgggaagacggctccggtcgatattgggttcccgagcagcccgtggagcagtgggaaggatggaacggtcaattggaggcgccctatacacatcgtcatcgttactgtgccaagtggtcgaaactaggatagaggaatgaataacttccgagaagtcaccaccaatcaagagctgattcagaagagcagagggactcagtgaagttccagaactggcctgatagcagccactacatgattaagaaaaaaacaagcagctttgttgtaaaaaagattggcttcatggtttctataatcatgaatttctcctccatgttccaattgtcacctgatttttaatccaagagtatcaaacttgatgtacccctttgtttaactgaaggttgctttctcacttggtatccctttctttcaaaatttaactttcaggaaataaaggtaaccagtttgctatgaatgttaacacatagccttctggacacaattagaa

SEQ ID NO: 293994 - DNA, 595 bp, Homo sapiens
caggaagtggctgagagggggagagagttggagagagacggccgcggaggacacggggacgggaaagtctgagagacggggagagcctgacccggcgggacacaggcaaaaagaaacacgcgagccagacagacgcagaagaaacgtgcctggtactggataggaacttcatggaatggagctaatgggccgtagggcaggtttgagtcgtgccaccctggagcagaaggtggagggtagggataagaacttccgagaagtcaccaccaatcaagagctgattcagaagagcagagggactcagtgaagttccagaactggcctgatagcagccactacatgattaagaaaaaaacaagcagctttgttgtaaaaaagattggcttcatggtttctataatcatgaatttctcctccatgttccaattgtcacctgatttttaatccaagagtatcaaacttgatgtacccctttgtttaactgaaggttgctttctcacttggtatccctttctttcaaaatttaactttcaggaaataaaggtaaccagtttgctatgaatgttaacacatagccttctggacacaattagaa

SEQ ID NO: 293995 - DNA, 817 bp, Homo sapiens
cgctgttcatcgggccgcgcggggaaggcggcggccaagatgcgctccgtcacgtaggatgagcaatacccacagcactccgttcaaggtcatctcctgggggccctctctggagccaccagacctctggacaccatggccaggttccttgccctccccaccccatcccagagcgcactcaccaactccacgggaggcaaggcctgacaggctgaagtcacctggaaggggaccgatgcctggtactggataggaacttcatggaatggagctaatgggccgtagggcaggtttgagtcgtgccaccctggagcagaaggtggagggtagggataagggggtggagcacctgattccaatcttgccacagggaagaagagtctgtgaagaagtgcgtgatgactcattccttagggtctttggctgggctctgggatggatgccatgggagtacctttacttaagctctaaagttaccaatggagagactgggactcaaagaggaacttgattggaccccagagaggtgagggggtggagagaaactaggagaaaagcacaggatgtagaggtctattcggcataatcttctccctcattttcatcttcaccatcaacagagagagcagcatacttgcttgcagaactgaacttctgtaacacaacgagagtgacaggataatgaaggccctgaattatcacatcaaaacccaagacacaggatactgatcctttggcaatgggggatgacagtcagatgacacccacttgcttgctcatcagcattgtccattggagaggagctagggaagagggt

SEQ ID NO: 293996 - DNA, 186 bp, Homo sapiens
gccttggggacaggggaagggaatgtcagtgtccttttgaaggctgtactggataaggggagaggagtcctacccccagcaggcccaagggcacaagatcagcagaggactcagacagttttttctttcctcataggatgagcaatacccacagcactccgttcaaggtcatctcctgggggccct

SEQ ID NO: 293997 - DNA, 501 bp, Homo sapiens
gggggaagccaggcgggaatgagtagggaggcactgggaggaggggagaggcaagagttaggggaataccgaggaaagtggcagggattggaggctcctggagaaagggcaaggctgaaggttgtcccatgtattttggccagatttgattatgtaatcgagaatcatgagataattaagtgtgttcatgtctctggagccttcaaccagctcttttaacatcttgctcttcccagcattccttagggtctttggctgggctctgggatggatgccatgggagtacctttacttaagctctaaagttaccaatggagagactgggactcaaagaggaacttgattggaccccagagaggtgaggggtaagggctagaacctcacacatgctggttttgctgctgcctggcaggcccatgggaagaactttagaggttccaaggaattggaaaagggtcacaagatgggtggccaaactcccagctcaggcttgattcctac

SEQ ID NO: 293998 - DNA, 354 bp, Homo sapiens
gagagttggagagagacggccgcggaggacacggggacgggaaagtctgagagacggggagagcctgacccggcgggacacaggcaaaaagaaacacgcgagccagacagacgcagaagaaacggtgggcgtaggtctagaagggactaggaacaaggggacagggaactgccgcgcagcgtcagcctcttaccctccccacaggagtgtgcctgggcttgggcctgacctgagaggaccacccgtggcttagcctggtggtgctagcgtcccctacccaggcgggcgcctgaatcaggtgaagacacctggtgttacttttggcccaagtcattggacacccttccctggtcc

SEQ ID NO: 293999 - DNA, 3372 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294000 - DNA, 3327 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294001 - DNA, 3214 bp, Homo sapiens
acaaatatttacacaacatgtaccttttggaaggtatacctgatctttaaagcaggtaaacatgttctaaaaattgacacattaatttgaaataatataggaaattgaagcttagattttatgataaacttaaaagaataggtacaacttttctgctttatttaaattttattttctggtttatttaaatttagtcaaattctgtttgtggcatttaacttcatacttggaaaaatatacagtctcccactgttgaggaactcttctggagagtatatttttatgtgataataagtagagatgatgaagaaatgatttttgtatgccaaaggatacaaaaatgtttttatttaagcgagaattaatcaaatctgttttaagaaaattaattacttgattttgaaaactgtaagatatactaatgaagttcttatggaaaataacctattttggagtaatatcccaagctggcagaggctcagtgaaactaaatattcttaagtgccattgacactatttattattggtctgtttttaaagcaacatgacaatatagaggaagagcaattaagattcccatacactttgaccctgttattccatccttaagaaattatttcaaagaaatagttcattagagatgaaaagcttattgtaacattgtctatcatagcaaaacatggaaaccacttcattgtcctgtgttaggggattggtttacttaatggtgctacaccaacaaaactgaatactgtgctgtcattaaaatgtgagactggagaaatgtatttgttctgatttagatattctgtatagtgtgattacagtgatatttaaaatatgcaaaaggtaatatagaaaaatgaaaatataaatatggttatgtttgacttcatatttttgtaaattgttaatgttatgatgcctattcaattgttttttaagacagaaagtaacctatttttatatcctgtgaaatacatcaaagttttggactatgaaatttaaaacaagcatgaaggacttggggaattgaaaaattgaaattgttatatgtgttttattaataagaagtacatgttacttttattttaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatttatcttttataagctcttaacttgaagttagagtaaaatagcgcggtgactcacacctgtaatcccagcactttgggaggccaaggcaggcggatcacgaggtcagaagatcgagaccatcctagctaacaagcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294002 - DNA, 735 bp, Homo sapiens
tgggttcaagcagttcttctgcctccctcccaggtagctgggattacaggtgcctgccaccacacccagctaatttttgtatttttagtggagatggggtttcaccatgctggccaggctggtttcgaactcctgagctcaagtgatctgcccgctttggcctcccaaagtgctgggattacaggcatgagacatcatgcctggccataaataagttttaaaagttgatctttgtgctcctctttccagatgtgaagtgaataactgtgagttttattttaggtttattttgtggccttgttataccttgctaataccattgtcctgtagatcttggaagagtttgtttttgggattccattgagattataaattcatagattagtgagattatggatccatggtctgtgcagaaaagaaaattaaatgtggagtgttattttaagcatttggtgcagttctttcgttataggatcactttggttttcttcagatctttgaacaggtactaagtgaactggagcccctatgtctggcagaacaggacttcataagtaaatttttcaaactacagcaacatcaaagtatgcctggaactatggtatggctcacagtgtattttggatagtatttatgatctgtaatataattagcttaattaatatgtggtcacaattttatgatcagaagagaaaaggaaagaatttatcatgtaaggatttttttatgatgtaa

SEQ ID NO: 294003 - DNA, 791 bp, Homo sapiens
agccaagtgtgatcctgcttgctcatcgagaatatctgttctttaaagacagttttggcgaaccctgacatttcatttgatttctgcattttggcctctcttccatcatatttggatgctgcatatgaagttgtcaaaaacaggaattttaacgaagaagaaaggaatgaagaaaaaagaaggaaacagaccaatcagtgtttctttagtaagaaatcataattcagaaagctatttgcacttggttaggtttacacagctcacactttttggcaggaacaggaaaaacttgttcaaaattctttgggaataagaatcactagccactgcctctagctgtactgaggctgaatctaagcaaagccccattttttggtatacagaaaatagttgtagcttggactgcccagattccctcctcccgggactgctaccttcgtctgcaactctgggtcatacatgtagggtagttagtagagatggtccatccatgcttgggtaggaaaggagttttcctctcctaatagcctcctgagattggcagtctgacttgaagatgactcacatgtcttctctccacctcagttttacatttgtagaatttgtcttattgttgtgaaccccaaatgtctgagacaagatctcagtcaatttaggaagtttattttgccaaagttaaggatgcgcacccatgatacagcctcaggaggtcctgacgacatgtgcccaaggtggtccgagcacaccttggttttatacattttagggagacatgggacgtcaatcagtat

SEQ ID NO: 294004 - DNA, 311 bp, Homo sapiens
ctactactactaaattagcggccgctcgactggatctacttctagtctaaataagctcagtgttcagagttcagggaatcgcagatctcagtcatcttccctgttggatatgggaaacatgtctgcctctgatctcgatgttgctgacaggaccaaatttgataaggtaaactaaaataacaagtacttcttaaacattaacattagttttctaacagcagtttgtggttgctctaagtgtgttcaaagatttgggttcttctggctctcttaagcattaaccatgtctttccaactgaatcgaatctggg

SEQ ID NO: 294005 - DNA, 3528 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294006 - DNA, 3537 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagtttactcaggccctccttcaactctataacaggtcctactttctttcggttcctggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294007 - DNA, 1644 bp, Homo sapiens
aagactgagcaggcttttgctatatcaatactagtcaaattgttggtcttttattatgtaaagtgcctgaataatttttgcaggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttga

SEQ ID NO: 294008 - DNA, 3543 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgaaatttgataatatttttaggtctatcatatgctgtcttctgtattaaagcaagttcttac

SEQ ID NO: 294009 - DNA, 2661 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcttctttgaagctgttgaagctcgcgtgcatcgataacaccggacggcg

SEQ ID NO: 294010 - DNA, 2660 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattcagatttggagatatcttaaggaaaaaatttacattactggaattctttgccttttgaagttttaggaggattaatattctgaataattaaacataaattatatttccttaaaagatttgtgccaacaagtgctttgtcccctagtgaatattcaaataagtaatcaataagctttttgcctaattgtgttcccagtgagtattattgccctatctttatatataatgcagtattcatgaatgtaatttaaagtgaagaaacaagattagagccaacctagtaatgatttatggaatcattctctgctcagagtatatttttgattgacaatattaatgagcttttttaaatgaaattgactttttcccaggaatgttgcgtcatcctgtgatttgagcttttcacagattatgtatttttacctcatcatctaatttggttgctgaagagttgtcaaaaacaggaattttaacgaagaagaaaggaatgaagaaaaaagaaggaaacagaccaatcagtgtttctttagtaagaaatcataattcagaaagctatttgcacttggttaggtttacacagctcacactttttggcaggaacaggaaaaacttgttcaaaattctttgggaataagaatcactagccactgcctctagctgtactgaggctgaatctaagcaaagccccattttttggtatacagaaaatagttgtagcttggactgcccagattccctcctcccgggactgctaccttcgtctgcaactctgggtcatacatgtagggtagttagtagagatggtccatccatgcttgggtaggaaaggagttttcctctcctaatagcctcctgagattggcagtctgacttgaagatgactcacatgtcttctctccacctcagttttacatttgtagaatttgtcttattgttgtgaaccccaaatgtctgagacaagatctcagtcaatttaggaagtttattttgccaaagttaaggatgcgcacccatgatacagcctcaggaggtcctgacgacatgtgcccaaggtggtccgagcacaccttggttttatacattttagggagacatgggacgtcaatcagtat

SEQ ID NO: 294011 - DNA, 1621 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagagacctcatgattctatctacttttgcctttagcaacatgatgagactgattatgtacataacttagagaaaatgaaaataaactgaaatgcactgaactaaaagtacaaccaggaaaaaactgaagttgtggaactttttaccatatgcttaagtttagaaatttttctctcaacatacatatacagaaacaagctataataaaataaaacctgtattgcagacca

SEQ ID NO: 294012 - DNA, 1565 bp, Homo sapiens
cgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaaggtatggatttgacgtcattta

SEQ ID NO: 294013 - DNA, 1492 bp, Homo sapiens
tcttgcgtatttatgattatcttatggtggtaatgttcatttgatatacacaggatataaaagttgtgtaagtatttggtttttatttttctgtgttctattcttaattatttttctatgtcttattggtttggcttggccacattttggtcattgtttagactttttattgtaacgtttctttgtactgttgattacatttatttacttattttactcactttagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattcagatttggagatatcttaaggaaaaaatttacattactggaattctttgccttttgaagttttaggaggattaatattctgaataattaaacataaattatatttccttaaaagatttgtgccaacaagtgctttgtcccctagtgaatattcaaataagtaatcaataagctttttgcctaattgtgttcccagtgagtattattgccctatctttatatataatgcagtattcatgaatgtaatttaaagtgaagaaacaagattagagccaacctagtaatgatttatggaatcattctctgctcagagtatatttttgattgacaatattaatgagcttttttaaatgaaattgactttttcccaggaatgttgcgtcatcctgtgatttgagcttttcacagattatgtatttttacctcatcatctaatttggttgctgaagagttgtcaaaaacaggaattttaacgaagaagaaaggaatgaagaaaaaagaaggaaacagaccaatcagtgtttctttagtaagaaatcataattcagaaagctatttgcacttggttaggtttacacagctcacactttttggcaggaacaggaaaaacttgttcaaaattctttgggaataagaatcactagccactgcctctagctgtactgaggctgaatctaagcaaagccccattttttggtatacagaaaatagttgtagcttggactgcccagattccctcctcccgggactgctaccttcgtctgcaactctgggtcatacatgtagggtagttagtagagatggtccatccatgcttgggtaggaaaggagttttcctctcctaatagcctcctgagattggcagtctgacttgaagatgactcacatgtcttctctccacctcagttttacatttgtagaatttgtcttattgttgtgaaccccaaatgtctgagacaagatctcagtcaatttaggaagtttattttgccaaagttaaggatgcgcacccatgatacagcctcaggaggtcctgacgacatgtgcccaaggtggtccgagcacaccttggttttatacattttagggagacatgggacgtcaatcagtat

SEQ ID NO: 294014 - DNA, 238 bp, Homo sapiens
tatgagccctggaagatcaagccagtagaagatagaagatctatccctgctttatactttggatcatttatttgtgaagatcacaactttcaaagttttattatttcttaggtcttcatggaagttcggggaaattaactggatctacttctagtctaaataagctcagtgttcagagttcagggaatcgcagatctcagtcatcttccctgttggatatgggaaacatgtctgcctc

SEQ ID NO: 294015 - DNA, 539 bp, Homo sapiens
ggtagatagatatacaaatgagcaataatttcattcttaagtcatagtttggcattgcttaaaaagttgtacattaggccaagcacagtaggtcacacctgagaagctgaggcaggcagatcacttgaggtcagttcataacaagcctggccagcatggtgaaaccccattgctaatagaaataaaaaaaaaagttatccaggcatggtggtgcacaccggtaatccctgctactcgggaggctgaggcagaagaatcagttgaacttgggaggcagaggttcaagcaattctcctgcctcagcctcctgagtagctgggattacaggtctaatttttgtatttttggtagagagggggtttcaccatgctggtcagtttggtctcgaactcctgacctcaggtgatccacccacctcggcctcccaaagtgctgggattacaggcgtgaaccaccacacccggcggcaattcagtcttttaatgtgctcagggaagtaagtgttacccttgcctcctttcttctctcacaccctacat

SEQ ID NO: 294016 - DNA, 445 bp, Homo sapiens
agtgcaacctgagctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagattccgagtgatgctgtacccctcaaggatttaaactaacgaaaattcattaaataatgtggatttgtgctc

SEQ ID NO: 294017 - DNA, 479 bp, Homo sapiens
ggagtgaagggtctgctgctgaaatttgggggcaaataaccggagtaggtttgttcctgtgccttgcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagattccgagtgatgctgtacccctcaaggatttaaactaacgaaaattcattaaataatgtggatttgtgctc

SEQ ID NO: 294018 - DNA, 416 bp, Homo sapiens
gtgggcgctatggcttggaccacagccttccagacatagttccttttagaagtcccgttcccagcaaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagattccgagtgatgctgtacccctcaaggatttaaactaacgaaaattcattaaataatgtggatttgtgctc

SEQ ID NO: 294019 - DNA, 4539 bp, Homo sapiens
ctaaatgaagagcgcttgggacctgaacaaccagcagcgatacccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataatggaatcagctttaattgcaaggaatgaagaaaaacaagagtggaccttcaaagctacaacattttcctcctcccctccctccccaccagccccttccccaccaagaactgctatgatgtcccaaagtgaggtgttgttgattccagtctcaatgggattttctgactttaatgtttgcaaggcatttcaccagaatacagctataaacggccgctcccaacaactgggctctgactcacccacacccacttagtgtccactaagtagtccagggtgactcagtttaagcacatctcaggtgaggtcactctgcatataccttggcttacctgaaatagcctgaacttgaatctcacataagggaaaactagtcatcaatcaccaactcattgactaccctcaggaagtcctgcagaaatcaagagtccttgaggagaacacgtggatcataccaaaaccagggtttaaatccattctgcttaagagttctatcagtcagtttaaccataaattacgctacagaaacaaacaacccaaaaacctcagtggcttacagatttatttttcactcacatgtttgtaatgatccatcttggttgtaatccatattgcttcagcacccagtctaaaggagcagcctctaaggggggcatgttggtcttaagagggaaaagaaaggtgggaaccacatgatggctctttcatcttccgctaggaaatgataccctttacttccatgacattccattagccaaaacaagtcctgtgacaggcacgatgtcagtcaccacagttaaattatcctgtcatagggagggatagtgaatattttgcagaagtaatatgatacaccataagggtacataatatccatgtctcccttcaaggagccatcctgttgtaggccataacggtaggcctattcatctgcacatttggtaatgtattcctggtgacaaagcagctactcttcaatcaaaagccgtgtaagaagcagttgaggaaaaaaagtcctggttgagctctgaaaaccttgcgttgataatttcattgaccaggatggcatcagtatcaaacttgaagaatgggtgtcagtgtctaagaaaaagattccagagacaatggtggtgtgctctttaacgaaatgcccatcaccactgctcttaatagcatgaagaccacatgctgtgagaaaacacaaacatcaattaccaagtcaagaaacagacactgaatgtgaaaaaggttttgaaataccttaagtaatttattttgtttctatttttccttctgtttgtgtacaagagtaatttaaaagaaaaagctatgtgaaaatagttggggttttttgtgtgttttgttttttgtggtggtgaaggaggaggcctaatgtccagaggactgtttatccctgaagtatgatatactaaaatatttcttattatttgtatcaattttccttggagctcaatgtgcccttgcagtcttcagactttattttaggaaaatatatttgcatgttttccccccattctcaatgtttggtgtcctggttcatcataccccacagaatgttatgtttatgtatcataccattcctctgtggacatgcatttactttgtttacaggttttggtttgggggttctctttttcctactctggacagtgcatgtacatttactttgcatgctggtgcttttttttctatagcaatagtgtctgatagacatatgcaagtcacatgtaatttaagatctagtagccacgctaaaaaacaagtaaaattaattttaatatatttaactcaatacattggagatattatttcagtaagatatttttcattcttatgaaactaagtctgtctggtttgcatatctcagttgagacactaaagttttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtattagtggctaccatattggtcagagcagattcataggatgatttcccaggtttgaagtgtgtgtatatttctggtattataagatgtcagactggtttttggagaaatatgttgtcttaatttttacctgctttgatatgacctttctgtgtgtacgtgtgacatttctttataaatgcaacatgttcacataggtcc

SEQ ID NO: 294020 - DNA, 4715 bp, Homo sapiens
ctaaatgaagagcgcttgggacctgaacaaccagcagcgatacccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacagagaatcaaaggccacattggatatgacagaagacaagtgctgagatttgacattatacttcttagagcacactcaaactgctccacctccatctatttcctcccccaccagcttctgtaccattggttacaagagccaggcttattatttgagacattattggagactggagacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataatggaatcagctttaattgcaaggaatgaagaaaaacaagagtggaccttcaaagctacaacattttcctcctcccctccctccccaccagccccttccccaccaagaactgctatgatgtcccaaagtgaggtgttgttgattccagtctcaatgggattttctgactttaatgtttgcaaggcatttcaccagaatacagctataaacggccgctcccaacaactgggctctgactcacccacacccacttagtgtccactaagtagtccagggtgactcagtttaagcacatctcaggtgaggtcactctgcatataccttggcttacctgaaatagcctgaacttgaatctcacataagggaaaactagtcatcaatcaccaactcattgactaccctcaggaagtcctgcagaaatcaagagtccttgaggagaacacgtggatcataccaaaaccagggtttaaatccattctgcttaagagttctatcagtcagtttaaccataaattacgctacagaaacaaacaacccaaaaacctcagtggcttacagatttatttttcactcacatgtttgtaatgatccatcttggttgtaatccatattgcttcagcacccagtctaaaggagcagcctctaaggggggcatgttggtcttaagagggaaaagaaaggtgggaaccacatgatggctctttcatcttccgctaggaaatgataccctttacttccatgacattccattagccaaaacaagtcctgtgacaggcacgatgtcagtcaccacagttaaattatcctgtcatagggagggatagtgaatattttgcagaagtaatatgatacaccataagggtacataatatccatgtctcccttcaaggagccatcctgttgtaggccataacggtaggcctattcatctgcacatttggtaatgtattcctggtgacaaagcagctactcttcaatcaaaagccgtgtaagaagcagttgaggaaaaaaagtcctggttgagctctgaaaaccttgcgttgataatttcattgaccaggatggcatcagtatcaaacttgaagaatgggtgtcagtgtctaagaaaaagattccagagacaatggtggtgtgctctttaacgaaatgcccatcaccactgctcttaatagcatgaagaccacatgctgtgagaaaacacaaacatcaattaccaagtcaagaaacagacactgaatgtgaaaaaggttttgaaataccttaagtaatttattttgtttctatttttccttctgtttgtgtacaagagtaatttaaaagaaaaagctatgtgaaaatagttggggttttttgtgtgttttgttttttgtggtggtgaaggaggaggcctaatgtccagaggactgtttatccctgaagtatgatatactaaaatatttcttattatttgtatcaattttccttggagctcaatgtgcccttgcagtcttcagactttattttaggaaaatatatttgcatgttttccccccattctcaatgtttggtgtcctggttcatcataccccacagaatgttatgtttatgtatcataccattcctctgtggacatgcatttactttgtttacaggttttggtttgggggttctctttttcctactctggacagtgcatgtacatttactttgcatgctggtgcttttttttctatagcaatagtgtctgatagacatatgcaagtcacatgtaatttaagatctagtagccacgctaaaaaacaagtaaaattaattttaatatatttaactcaatacattggagatattatttcagtaagatatttttcattcttatgaaactaagtctgtctggtttgcatatctcagttgagacactaaagttttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtattagtggctaccatattggtcagagcagattcataggatgatttcccaggtttgaagtgtgtgtatatttctggtattataagatgtcagactggtttttggagaaatatgttgtcttaatttttacctgctttgatatgacctttctgtgtgtacgtgtgacatttctttataaatgcaacatgttcacataggtcc

SEQ ID NO: 294021 - DNA, 415 bp, Homo sapiens
acatagtgaaaccccatctctactaaaaatacaaaaattagccaggggtggtggcagatgcctataatcccagctactggggaggctgaggcaggagaattgcttgaacccgggaagtggaggttgcagtgagccaagatcgctccattctactccagcctgggcaacagagcaagactccatctctcaaaaaaaaaaaaaattaagcctgattatgattctcaagttagcacaacaaatgatgccaatgcctcctttccccttctcttagggtgatctggagctccctggtcctagcagttattttctggttggcctttgacactgccaaattgggtcaacagcagctggtgtccttcggtgggctcataatgtacattgtcctgttatttctattttccaagtacccaaccag

SEQ ID NO: 294022 - DNA, 2751 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294023 - DNA, 334 bp, Homo sapiens
cggcacgaggggtattcaaagggcaggatgagctgctaggggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294024 - DNA, 466 bp, Homo sapiens
  misc_feature (438)..(438): n is a, c, g, or t
  misc_feature (462)..(462): n is a, c, g, or t
ctgcccactcccctgacccatttctccctcctcttcagtctgaagaaagaagcttatgaagtggaagttcacaggctgctcaggtatggcctaggacaattggggtgtagcagggagcaaagagtcaaatactggggatcttggccccataatttacagggtcctgtgcaaaatgaaaatcagggccctcatctcaaacattaggattacaggtgtgagccaccacactgggccaatgcttaatattttaatgtatctcaacaataaaaccaagaagaaacaaagccttttgacttgttagaatgtattaagtagtattttaaagaaactttatagttgtgacattgaaagactgttggggtggggggaggaaaatttttactttccatcttaatgtaaccttatgctattctgtatttttactgtatattgcttttncaataaatataaaatgaaatgttnaaaa

SEQ ID NO: 294025 - DNA, 657 bp, Homo sapiens
agcggggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtcagtgggccagggtctggtgtacagtcactctattctgctcagggcatggtccactggcagcagggtctactgcctaagtgggaactgcaactctgccagtttctagctgtgtgactttggagtcctcgattccttatctat

SEQ ID NO: 294026 - DNA, 426 bp, Homo sapiens
aggccaaattaaagctagtaagagcttgctgaggatgctgcaaagaggatggagaagacggtgggaaattagagggctctttacaggtctaggacttcatttgtgtgtcttatagatgtctggctggtcagcaagtgggtgtgggccagacaatgtgaggtgctgattttcactctcatacccactccaggaggcctacttcaagaagcacaagttcaacacggttccaggtgtccagctcaggaatgtggacaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294027 - DNA, 2736 bp, Homo sapiens
gctggtactggcccgaattttatggatgcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294028 - DNA, 2860 bp, Homo sapiens
ggctgtacggctcggagttacgggatactgtcagccggtcggtggtgctggtgtctggcaggctgtccagctgctcgccttgagcggctgggctccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294029 - DNA, 2832 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggtaggctggaatgaccagggtttagcaggcgagtttatgaggcctcagctaatacctcccactatggcaccctgtccccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294030 - DNA, 2966 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggtaagcctgggaatgggctatacccagcactgaacaggagggtgcttaggtcatctacctccaggaggaactcttgaggtgggcagaaaggcaatagattctagacgcattcacctctgtgggtaagcatagggactctgggcccagctgtaaacacaggggaacctgagttgaggggtgatgaagtgaccctaacctatccctgggctccccaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294031 - DNA, 2835 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaaggtaactgtcagggtagggtgagggggctggagtcccctaccaactcgaaacatcttaaccttcatcgtggtccatgtctgccagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294032 - DNA, 3141 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggtaagcctgggaatgggctatacccagcactgaacaggagggtgcttaggtcatctacctccaggaggaactcttgaggtgggcagaaaggcaatagattctagacgcattcacctctgtgggtaagcatagggactctgggcccagctgtaaacacaggggaacctgagttgaggggtgatgaagtgaccctaacctatccctgggctccccaggatgctgcgctctctgctttcagcccagggggtgtctcctcagatgataacagttttcattgacggctactatgaggtgagcaggacttggggggtgcctcgggtggagtacaacatggagcagcagtgattgccagggacgggcaagggagaccgcccaggcaagggctgtgaaatgtgaaggccttggattgcagaggtgggcagagggaaagtgacctcacatggtgagcagtggccatgtcccccaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294033 - DNA, 3234 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcaggtatggcctaggacaattggggtgtagcagggagcaaagagtcaaatactggggatcttggccccataatttacagggtcctgtgcaaaatgaaaatcagggccctcatctcaaacattaggaacttcaggccgggcgcggtggctcacgcctgtaatcccagcactttgggaggccgaggtgggtggatcatgaggtcaggagatcgagaccatcctggctaacacggtgaaaccctgtctctactaaaaatacaaaaaattagccgggcgtggtggcaggcgcctgtagtcccagctacttgggaggctgaggcaggagactccagcctgggcgacagagcaagactccatctcaaaaaaaaaaaaaaaaaaagaacttcaaggtggcaacagcagagcattcaaccaagtacagggtcctgtgggacacacccatgaagtgggccctgtcttggctatattctcccaccctctactgcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294034 - DNA, 2697 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294035 - DNA, 3252 bp, Homo sapiens
  misc_feature (2782)..(2782): n is a, c, g, or t
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctgggaaaaaaaaaaaaaaaaaaaaaaaaaaaaaanaaaaaaaaaaaaaaaaaacaaaaaaaaacctatacacaaaaaacaaaaaaaatacaataaaaactcttaggggggcctcgagcccccataagccttaaagggggtctaattaaaaatccctggccgtcttttacaaacttggaggctggggaaacccctggggggcccaaactcatacgccttgggaaaaattcccctttccccacttggcaaattcgcaaaggggcccttacgattggccctacctaagcgtggacactccgtagtggcaatggcctacttgaacgcttatatttttttcgaaaaatcccctttaaactttatgtaaaacaactgattttttaaaccactggtccacacatgtggaactcctttttaattcaaagaaataccctcttaaaggctaaaggttttcccccttagatccagatgttcccttctaaaatagggctctccccctaaaagtgtca

SEQ ID NO: 294036 - DNA, 2767 bp, Homo sapiens
  misc_feature (2767)..(2767): n is a, c, g, or t
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatgttcgcgataagttttacaactccacagggtgggttcaattttgaatttataaaggagaacctccagn

SEQ ID NO: 294037 - DNA, 2069 bp, Homo sapiens
gtcttgccacgtgtgcaaggggattggaagcgtgatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294038 - DNA, 2370 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294039 - DNA, 2528 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294040 - DNA, 2486 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctggggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294041 - DNA, 2370 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294042 - DNA, 1742 bp, Homo sapiens
gctggttgatctcctagaggtataccctactgccgttcctctactctcgggtggagtacaacatggagcagcagtgattgccagggacgggcaagggagaccgcccaggcaagggctgtgaaatgtgaaggccttggattgcagaggtgggcagagggaaagtgacctcacatggtgagcagtggccatgtcccccaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294043 - DNA, 4005 bp, Homo sapiens
  misc_feature (2351)..(2351): n is a, c, g, or t
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggtaggctggaatgaccagggtttagcaggcgagtttatgaggcctcagctaatacctcccactatggcaccctgtccccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgtgagtgggaggcagggagcagggcacagtgtggcatgacagtcaagaacaagaacatggactctgaagcaatcttagctctgctacttgctagccatgtaaccttggggaaagagctatcctatttttgcctcagtttctttatctgaaaaatgaggataaagggctgggcgcggtggctcacgcctgtaatcccagcactttgggaggccgatgcgggtggatcacaaggtcaggagatcgagaccatcctggctaacatggtgaaaccccatctctactaaaaatacaaaaaattagccgggcctggtgatgggcgcctgtagtcccagctacttgggaggctgaggcaggagaatggcgtgaacccaggaggcgaagcttgctgtgagccaagatcacgccactgcactccagcctaggtgacagagcgagactccatctcaaaaaaaaagaggataaaatactactacctcactgggttacgatattttgaggtttaaatgagtcaatatatgtaaagtgctttgaattataaacatatataagngtcagctggtattgtttttatttttactatttttagcactagactgtgggtgtctggggagagtatttctgcctctaagtactggtccagccctgcaatctctgccctttcctgttttggcaagtgctggagcctatgcttcagcctgaggagaacagggaagtccttaggtaccgccaacccacctggctgcattcagaggaccattccccagttacagcaagggaggccttgagccagcccagcccaaaggaatgaatagcgtccagcttggaacctcctagaagccagaggtccctcagaggctgactaatacgcgagccccattcctctcccagagaggggcaggcgcttccctcaggtcactctcagtaccagagtcaaagtagttttttccttcccagcccagcccgtccctttgcccaccacctcctgcagggcctgtttctgacatctgtggctctagaacagcaggcccagggagaactacaagaggcagggactgctagttcatgggtctgtggtgcagtagtgtgagctgccgtgacagcatgagctctccacccttggacagccttgattcagagagttactccagtctcagggaatttccaggtgatccaaccccactgaagggtttcctgccagcccagagaagttgagccactttccccatgtcacacagtatgggtgcttgcagggaagagttgctgggaggtcctccctcatctccccagaaggcatcagactttgggaggagcatcttaccccatgtggccctctggtcccttcagattcctgaagtcatgggctggccaggacattggtgacccgccaatccggtatggacgactggaagcccagccccctcatcgagccctttggggctcggaagaagcggagctggtaccttacctggaagtataaactgacaaaccagcgggccctgcggagattctgtcagacaggggccgtgcttttcctgctggtgactgccattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggtcagttattctgtcctgaccctgacccctactccctagctccaaccctgcttctagccccggcttctctgcccctcatataacatagtgggaagattctctgaaggaaggttactcaggttccaatctcagccttaacatttgtattaattcagcaaatagttattgagcaacagctgtatgccaggtacttctctgggtgctgaagatacaatgggaaacaagacagagtccccaccctcatggagcttatattccagcagtgggaggtcaacagaaacagccaagtaaatgtggataatgctagtaaatgataacttgtat

SEQ ID NO: 294044 - DNA, 1181 bp, Homo sapiens
cctacgctggaagctccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294045 - DNA, 977 bp, Homo sapiens
caaatagtctaggtcgaggccgggtggtgatgaagtggaagtcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294046 - DNA, 1468 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294047 - DNA, 751 bp, Homo sapiens
cctagttttagaagtttcaatagcagggatatagctaatggcttcttctctatacattcttgtattattttcccagagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 294048 - DNA, 1096 bp, Homo sapiens
agcggagcggggggggcacgaggggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccaccaccatgaaccccacgagccggggatactctagag

SEQ ID NO: 294049 - DNA, 296 bp, Homo sapiens
aaaaaaaaaaaaaagaacttcaaggtggcaacagcagagcattcaaccaagtacagggtcctgtgggacacacccatgaagtgggccctgtcttggctatattctcccaccctctactgcagtgaggctgaggttctggaccacagcaagaacccttgtgaagactctttcctgccagacacagagggccacacctacgtggcctttattcgaatggagaaagatgatgacttcaccacctggacccagcttgccaaggtgctccaataccatgcccaccctggagaacccctccc

SEQ ID NO: 294050 - DNA, 334 bp, Homo sapiens
ccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagcc

SEQ ID NO: 294051 - DNA, 537 bp, Homo sapiens
agaagaaccacttcctggtggtgggggtcccggcttccccctactctcgtgagtgacccttttctgccctgggaaacaggaggcctagtgagatccagggatatagctaatggcttcttctctatacattcttgtattattttcccagagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcaga

SEQ ID NO: 294052 - DNA, 2773 bp, Homo sapiens
gagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatcctagaggagcttaatgtcacccggccagggcacttcgactttgtaaagcctgaggacctggacggcattggcatgggccggcctgcccaacgcagactgtccgaagctctgaaaagcctacgttctgggcctaagtctaagaactgggtctacaagatccttggaggttttgcccctgagcacaaggagcccaccctgcccacggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcttaacggccccggccccgacacccccgctgctcgtggccctgctctgcctcttcctgcggcagctggcgggagccatggcgtacctgggggcccgcgggctggtgcaccgagacctcgctacgcgcaacctacagctggcgtcgccgcgcaccatcaaggtggctgacttcgggctggtgcggcctctgggcggtgcccggggccgctacgtcatgggcgggccccgccctatcccctacacctggtgtgccccagagagcctgcgccacggagccttctcgtctgcctcggacgtgtggatgtttggggtgacgctgtgggagatgttctccgggggcgaggaaccctggcccggggtcccaccgtacctcatcctgcagcggctggaggacagagcccggctgcctaggcctcccccctcctccagggccctctactccctcgccttgcgctgctgggccccccaccctgccgaccggcctagcttttcccacctggaggggctgctgcaagaggccgggccttcggaagcatgttgtgtgagggatgccacagaaccaggcgccctgaggatggagactggtgaccccatcacagtcatcgagggcagctcctctttccacagccccgactccacaatctggaaggaccagaatggtcgcaccttcaaagtgggcagcttcccagcctcggcagtgacgctgacagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggagatggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgttatgtcctggccaggccctgagcccagcttctgcgggcacagacaccagcatgaaaagcctaggtccctgagggcctggccacatgggaccaagtggaaccagaacaaggccccgacaggggtagacgttccacttgtggagatcccacctgccgctaggcacgtggaggaggagcccagagttgggcactggcaaatgtctcctccctcccatgctccttggcttctgaaggctgaagcccctttggctgggccaagaaggatctagtctgcccactacattctcaaacaagaggacttggaggaaaagagctactatacatcatatgcagaggaagcttctacgcgctagagaggatcaaggggccacactggaccatgtgaacagccatccggaactgccatcagctaccacactggactctgcagggcagccatcctggatgatggaagccaccatattgacctggggtataggcccaaactgccttcgtttggtccagggccatcgtgggtgatgacgattgctctcttgcactcatggacatttgatgctggtagtatggattatgagatggactagcccctgctccagcccagttctcacattcccctttgttttttcccataccaactgcttctaccctcccctattacatacatctttcaatgtccaa

SEQ ID NO: 294053 - DNA, 2013 bp, Homo sapiens
  misc_feature (32)..(32): n is a, c, g, or t
  misc_feature (39)..(39): n is a, c, g, or t
  misc_feature (116)..(116): n is a, c, g, or t
  misc_feature (216)..(216): n is a, c, g, or t
ccgcgggcggtcgggctctgagccgggcggantccggangggcagcagccgagggagatcggagggggccgggcttctgagggaggcttggaccagaagggttatcctcctaggcnaaagaggacttttgtgaaagatgggtgcactcgggggtgctccgtggagggtgggcctccaaggagcacgtgtcccgcccctttcagctccactttcttncggcaggtgtgccccagagagcctgcgccacggagccttctcgtctgcctcggacgtgtggatgtttggggtgacgctgtgggagatgttctccgggggcgaggaaccctggcccggggtcccaccgtacctcatcctgcagcggctggaggacagagcccggctgcctaggcctcccccctcctccagggccctctactccctcgccttgcgctgctgggccccccaccctgccgaccggcctagcttttcccacctggaggggctgctgcaagaggccgggccttcggaagcatgttgtgtgagggatgccacagaaccaggcgccctgaggatggagactggtgaccccatcacagtcatcgagggcagctcctctttccacagccccgactccacaatctggaaggaccagaatggtcgcaccttcaaagtgggcagcttcccagcctcggcagtgacgctgacagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggagatggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgttatgtcctggccaggccctgagcccagcttctgcgggcacagacaccagcatgaaaagcctaggtccctgagggcctggccacatgggaccaagtggaaccagaacaaggccccgacaggggtagacgttccacttgtggagatcccacctgccgctaggcacgtggaggaggagcccagagttgggcactggcaaatgtctcctccctcccatgctccttggcttctgaaggctgaagcccctttggctgggccaagaaggatctagtctgcccactacattctcaaacaagaggacttggaggaaaagagctactatacatcatatgcagaggaagcttctacgcgctagagaggatcaaggggccacactggaccatgtgaacagccatccggaactgccatcagctaccacactggactctgcagggcagccatcctggatgatggaagccaccatattgacctggggtataggcccaaactgccttcgtttggtccagggccatcgtgggtgatgacgattgctctcttgcactcatggacatttgatgctggtagtatggattatgagatggactagcccctgctccagcccagttctcacattcccctttgttttttcccataccaactgcttctaccctcccctattacatacatctttcaatgtccaa

SEQ ID NO: 294054 - DNA, 1221 bp, Homo sapiens
gggaggcggaggctgcagccagccgagttcaagttgtttccttctcaactgtgcaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggagatggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgttatgtcctggccaggccctgagcccagcttctgcgggcacagacaccagcatgaaaagcctaggtccctgagggcctggccacatgggaccaagtggaaccagaacaaggccccgacaggggtagacgttccacttgtggagatcccacctgccgctaggcacgtggaggaggagcccagagttgggcactggcaaatgtctcctccctcccatgctccttggcttctgaaggctgaagcccctttggctgggccaagaaggatctagtctgcccactacattctcaaacaagaggacttggaggaaaagagctactatacatcatatgcagaggaagcttctacgcgctagagaggatcaaggggccacactggaccatgtgaacagccatccggaactgccatcagctaccacactggactctgcagggcagccatcctggatgatggaagccaccatattgacctggggtataggcccaaactgccttcgtttggtccagggccatcgtgggtgatgacgattgctctcttgcactcatggacatttgatgctggtagtatggattatgagatggactagcccctgctccagcccagttctcacattcccctttgttttttcccataccaactgcttctaccctcccctattacatacatctttcaatgtccaa

SEQ ID NO: 294055 - DNA, 1922 bp, Homo sapiens
gagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatcctagaggagcttaatgtcacccggccagggcacttcgactttgtaaagcctgaggacctggacggcattggcatgggccggcctgcccaacgcagactgtccgaagctctgaaaagcctacgttctgggcctaagtctaagaactgggtctacaagatccttggaggttttgcccctgagcacaaggagcccaccctgcccacggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcttaacggccccggccccgacacccccgctgctcgtggccctgctctgcctcttcctgcggcagctggcgggagccatggcgtacctgggggcccgcgggctggtgcaccgagacctcgctacgcgcaacctacagctggcgtcgccgcgcaccatcaaggtggctgacttcgggctggtgcggcctctgggcggtgcccggggccgctacgtcatgggcgggccccgccctatcccctacacctggtgtgccccagagagcctgcgccacggagccttctcgtctgcctcggacgtgtggatgtttggggtgacgctgtgggagatgttctccgggggcgaggaaccctggcccggggtcccaccgtacctcatcctgcagcggctggaggacagagcccggctgcctaggcctcccccctcctccagggccctctactccctcgccttgcgctgctgggccccccaccctgccgaccggcctagcttttcccacctggaggggctgctgcaagaggccgggccttcggaagcatgttgtgtgagggatgccacagaaccaggcgccctgaggatggagactggtgaccccatcacagtcatcgagggcagctcctctttccacagccccgactccacaatctggaaggaccagaatggtcgcaccttcaaagtgggcagcttcccagcctcggcagtgacgctgacagatgcggggggcttgccagccacccgtccagtccacagaggcacccctgcccggggagatcaacacccaggaagcatagatgggtgaggacctgaaagggtgagggcaggggttggctgggagaactgatgaggtccaggagcttctctggaagagaagcctggggacaggaccagagtgaagctgcagcctccaccctgggccctgggtctcctgggttcccctgtgagtttttttgggagggtatattgatctgtggggtggggagagttggtgtggaggatgaactggatccctctccgacagagacagaaagaaggcaaatctttgggatgcgcccccagcacggggccagaggaggaacatgcccctggagaggatgaaaggtgggtgtggtggactccagagtctctgaggagatcaagaccagtccttcaattccgaccccctgccctaaatccatgcctttgcatctat

SEQ ID NO: 294056 - DNA, 1125 bp, Homo sapiens
cacacccatgaagcatagatggagacagaaagaaggcaaatctttgggatgcgcccccagcacggggccagaggaggaacatgcccctggagaggatgaaagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggagatggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgttatgtcctggccaggccctgagcccagcttctgcgggcacagacaccagcatgaaaagcctaggtccctgagggcctggccacatgggaccaagtggaaccagaacaaggccccgacaggggtagacgttccacttgtggagatcccacctgccgctaggcacgtggaggaggagcccagagttgggcactggcaaatgtctcctccctcccatgctccttggcttctgaaggctgaagcccctttggctgggccaagaaggatctagtctgcccactacattctcaaacaagaggacttggaggaaaagagctactatacatcatatgcagaggaagcttctacgcgctagagaggatcaaggggccacactggaccatgtgaacagccatccggaactgccatcagctaccacactggactctgcagggcagccatcctggatgatggaagccaccatattgacctggggtataggcccaaactgccttcgtttggtccagggccatcgtgggtgatgacgattgctctcttgcactcatggacatttgatgctggtagtatggattatgagatggactagcccctgctccagcccagttctcacattcccctttgttttttcccataccaactgcttctaccctcccctattacatacatctttcaatgtccaa

SEQ ID NO: 294057 - DNA, 624 bp, Homo sapiens
  misc_feature (19)..(19): n is a, c, g, or t
gccagggcccagccctaanctcttgcccttattcccatcctatttaccagctcctctttccacagccccgactccacaatctggaaggaccagaatggtcgcaccttcaaagtgggcagcttcccagcctcggcagtgacgctgacagatgcggggggcttgccagccacccgtccagtccacagaggcacccctgcccggggagatcaacacccaggaagcatagatgggtgaggacctgaaagggtgagggcaggggttggctgggagaactgatgaggtccaggagcttctctggaagagaagcctggggacaggaccagagtgaagctgcagcctccaccctgggccctgggtctcctgggttcccctgtgagtttttttgggagggtatattgatctgtggggtggggagagttggtgtggaggatgaactggatccctctccgacagagacagaaagaaggcaaatctttgggatgcgcccccagcacggggccagaggaggaacatgcccctggagaggatgaaaggtgggtgtggtggactccagagtctctgaggagatcaagaccagtccttcaattccgaccccctgccctaaatccatgcctttgcatctat

SEQ ID NO: 294058 - DNA, 294 bp, Homo sapiens
aagtagtcattcccacagaaagggacagagaggaaatgtccacatcccaaccttggcagtgagtagagagtaaagatacaaacaaccttccttgagaatttgaagtgtaaattagtaatgattcaagttcacagtccgaattcatactgccagtagcgtccaaagaaaccttgaggcaagaattcagagttttctcaattcatagtgctcttggatgaggggaaaaataactctgcaataacttgacataaaaccaggtcattggctgttctgacttccaatattaaaatgtgg

SEQ ID NO: 294059 - DNA, 550 bp, Homo sapiens
cccagctgtttaccaatccccacccagtggggacagaagacaacttaattccacaaagttggacccccaagggaagtggggaggtgagagggaaagaaggatgtggtctccatctaaagtcaagatctcttccccagaagctagaggtaaacttgcccagctcggactaggcctagagaggctgaatgatgtggcatcacccggaaacagcgtttaccctccttatcctcttcccttctgcctgaaaacactaatccagatgatggacaatgattcaattagtcatcttctctgatgggggctgagatccaggctgggatcccgtggaagtgccgggcaatcctctctgcaagtggctctgtgctccctcatcaccaaggacccatgtcactttggcattgcttctcctcagctacttctcagttactggtcctcatttggagagatggatatccggctggaagcatcccctacccgctgggagagtgggtctacagctcagggtctacatgtggaccagggcctcagaatgtgggtaaatgtgagtcag

SEQ ID NO: 294060 - DNA, 549 bp, Homo sapiens
aagaatctatccataattttattcttctaatatagatccctgtaattatttcatcctggaattcacagccagaaaggagtttgcctgcagactgcaagcttcttgcaggccgaacttagacttcattcttcataaccttggcaccaagcacagtgcacagtatgtgggaagtcagctgccatgttttgagctgccctctggaaagaccctcgtggtgaggaactggtggctctggccaacatccagcgaggacctgagatctgccagctgccacatgagtgagctgggaagtggatcttctcctagccttgagataactgcaattctggtcaatttgatcattgctctgcaggacacccagaggtgtcagctgagtcacaaatggatttctgacccacagaaactgagtgaaataatcactacaggtaagcaatgatatgaatggtgaatgctgacgctgtgggattgctgggtgtcctgaggaagaccacgtggaaagggaactcagagctaatacctacaaataaatacatcaaactgccatgatta

SEQ ID NO: 294061 - DNA, 5426 bp, Homo sapiens
  misc_feature (1655)..(1655): n is a, c, g, or t
tttaggaggaatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggcnatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatccttgtatattgattagttaaagggataattaatttaatgctgaggagagtttgacagattttgaaaatgagtaaaggcaaaaaaaatttttttagcctttattttgcctttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtgcagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 294062 - DNA, 5259 bp, Homo sapiens
  misc_feature (1488)..(1488): n is a, c, g, or t
tttaggaggaatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggcnatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatccttgtatattgattagttaaagggataattaatttaatgctgaggagagtttgacagattttgaaaatgagtaaaggcaaaaaaaatttttttagcctttattttgcctttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtgcagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 294063 - DNA, 5372 bp, Homo sapiens
  misc_feature (1655)..(1655): n is a, c, g, or t
tttaggaggaatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggcnatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatccttgtatattgattagttaaagggataattaatttaatgctgaggagagtttgacagattttgaaaatgagtaaaggcaaaaaaaatttttttagcctttattttgcctttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 294064 - DNA, 2897 bp, Homo sapiens
  misc_feature (1655)..(1655): n is a, c, g, or t
tttaggaggaatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggcnatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaaga

SEQ ID NO: 294065 - DNA, 945 bp, Homo sapiens
agagagatttccaacctcttgcatcccctcctctagggctcatgggacctctggttctgaatgcatattcccctaaaatcaaagaacttgaagactgaaaaagaccatggttattgtcaacttaagtggtctccaagatgggctataagacaccagattgaagtgtaagaagaaaatatgagaacatttaagagtatttctttttgagcttgaaatttaaaaagatattcagctttactaatattcatggtggtgctcttgctcaggagaccttagtggctgacagagaacctaaaccctggcttgcaactcgaggctgtgtgaaaggaatcggaacttacttctcacggtgactcgaatccacgtgctgaggatggggctgtgaacgttatcagctgcacagtagtatctccctgcatcactctccttcacggtgagaacatgcagctctgccaacagggaacgctgggtctttctacccaggcttcttactcttccttctttgtgccaggagaatgtgacagtccctgaaccctgggctactgagcaaataaggaccatattttctccttcaatcagctgccctccggtgggccggatctctagattcacattagacacagggactcctgggggaacacaagatggcatgtgaaggtcctgatggcagggacatcaaggtcaaggggaaggctggagctaccatgaataggccaatagcagcaggtgcagcaggcagaagcccaaagtaggaaataagaaattaattgtgtatacgattataaaggaagcaacatccctctcactcccacaacattcccatccttgagaaatgtgggcaccaagtccataatctccataaatccaatgttttctggtcacattttatatgcatttatctctaaggaatctttgatgcatcaataaaccacaaaataaaagaga

SEQ ID NO: 294066 - DNA, 304 bp, Homo sapiens
ggtgcacaggacgtcactggcttcgcgctccgagaagtatctctgccggaggatgcggtccaggagctccccaccatggactacctccattcccagggggtaggagccatgcctggggcagccttcggggaggagggagcttcagggcaggaaccaaaaccacaagggtttatgggttcaagagctgagaacgcggattgtcctggaattccttccgtgccaccatcgtctctcttgtgtctggaggctcagtgacggtgcaagggaagaaaaattctcttcccagccgggtgcagtggctcac

SEQ ID NO: 294067 - DNA, 5839 bp, Homo sapiens
ggccggcgctggtactcggcacgaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggtgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgccgcctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 294068 - DNA, 5785 bp, Homo sapiens
ggccggcgctggtactcggcacgaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggtgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgccgcctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgccctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 294069 - DNA, 5719 bp, Homo sapiens
ggccggcgctggtactcggcacgaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggtgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgccgcctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccaccccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 294070 - DNA, 5321 bp, Homo sapiens
gatgctactcgggttcatactatcgatgtatgaaggcgcgcacatcggcgagctgcatactgaaagcggagctgtgcaatacgcggtctgtgcgacgtgaccgttgacacggacggagaagctctaactgaatccgtgacttcgtggggggaggggacctcttcactccggatctccgataagacgtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgccgcctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 294071 - DNA, 4242 bp, Homo sapiens
ctgtattgtatgtgcatgtgtacacacatgtagaatcttgttttagaggtttttactgctacgactttacaatgaaatggaaaaataccattattgcacatgaacccactggacatatctgatggctccagattgtagattttgcggtttctgattatttgtagtaaatatttatgggtagtcctgataaaaaatgtaagtatgtgcatcattatgaattgatttctacctgtggaatattaattatttcagcttttccctttggaaagatataattgttacaagaaacagtgtttcatcgatttacatgcatcatctaatatttccacatttaactttttagacatgaaatatttaataaaagataaaccttcagtgaacttccaagtttggtaatatttaaagctaaaaaccattgacatacttctaaacctgaaagtgaacatgaccccataatgcaaagacccacactcagcatagtggttgggtgttgccatagagggagaggagttctgctggggaggctctctgacccagcacaaatgatccaaccatccccccgactctcatgaccttccctggcaggacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgccgcctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 294072 - DNA, 2036 bp, Homo sapiens
ggccggcgctggtactcggcacgaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggtgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagcccctcccagcaggcatgcggcggaggacggtcatcagcaataagatgtagcatgtgccttctgcccactaccgggtccccgagcccatctcacaggctcccacccaccagccaaaacttggctctcaactctcccactgcaaacctctccccggtctttcaacacaggctagtttcctattgtttaggaatgcaacacattaccccacatctagtggcttaaaacaacctgagcttattgtcttccagctctggatgtcagaattctgaaatctgtctcactgggctaaagtccagtgtccccaaggctggttccttccgcgggctctgggggctgagagtggatacacagcagatggtggccaggctgggtgcccgacagaagtctgacccacacctgcagccagcccctttatctacaatacatagctcgggaggccagcagctgtgtcaggcttgc

SEQ ID NO: 294073 - DNA, 1265 bp, Homo sapiens
ggccggcgctggtactcggcacgaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggtgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgagaaaacggccctctgcccccgtgtgagttgctccaggctcctaggcttctgagtctaagactggcatttctcccacctccacatcccctgaagataaaatgtcttcgttc

SEQ ID NO: 294074 - DNA, 3685 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294075 - DNA, 2546 bp, Homo sapiens
gttgtgaatgagtattaaaatagttgtggtttctgttatggctggtatatagtttcaccatagcctgggaacatcacaactgctgccttgcacccaccttggactttaaaaagtcatttaggcagcatgtggctgagaactaggttgctcaagtgaaatatataataaggagtatagcccattcattttaaaacaccatataaatcaacttaggtagtctgcaggctctttggtactgctccacaatgagattaagagtctgccagaacattagtcatctagaaaatcatgttgcaatatttatgtatgtatatttagttgaaataaacagtatatttagtggtacagttgatttatatcctgaagttctttaagaggggccagtaaccaaaacctccatgatcagcagcagtccacagaccacatagtgtgtgtagatagcatccttatagcgcaatatagaagcatactttcagccaaatgtttgcttgcacatagaggactttgccttgtaatttaagaaaaacagactcttcagtttgtactctaaatgctaagtgattgctcagcagcattaagtacagttttctattagttcaaaatacacaatctcaaggtaatttaggagcttttaggagatgtagaaatacttcatttttcattggacttgttttgtcagctttttgggggtcatttttattcaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294076 - DNA, 842 bp, Homo sapiens
gttgtgaatgagtattaaaatagttgtggtttctgttatggctggtatatagtttcaccatagcctgggaacatcacaactgctgccttgcacccaccttggactttaaaaagtcatttaggcagcatgtggctgagaactaggttgctcaagtgaaatatataataaggagtatagcccattcattttaaaacaccatataaatcaacttaggtagtctgcaggctctttggtactgctccacaatgagattaagagtctgccagaacattagtcatctagaaaatcatgttgcaatatttatgtatgtatatttagttgaaataaacagtatatttagtggtacagttgatttatatcctgaagttctttaagaggggccagtaaccaaaacctccatgatcagcagcagtccacagaccacatagtgtgtgtagatagcatccttatagcgcaatatagaagcatactttcagccaaatgtttgcttgcacatagaggactttgccttgtaatttaagaaaaacagactcttcagtttgtactctaaatgctaagtgattgctcagcagcattaagtacagttttctattagttcaaaatacacaatctcaaggtaatttaggagcttttaggagatgtagaaatacttcatttttcattggacttgttttgtcagctttttgggggtcatttttattcaggatgaagatgcatcagggggcgatcaagatcaggaagaaagaagatggaacaaaaggactcagcagatgcttcatggtcttcaggtattgccactgttgtctcagaggaaaatgcttcatcaaaggcttttgccattg

SEQ ID NO: 294077 - DNA, 3561 bp, Homo sapiens
ccccttcgccccgggcccgccctcggcccggacccatgcagcttgggcccgcatcatcgcttgttcggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294078 - DNA, 3614 bp, Homo sapiens
ccccttcgccccgggcccgccctcggcccggacccatgcagcttgggcccgcatcatcgcttgttcggtaacaaatgattctgatccattctgagatctacaaaggctgttaccctgcaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294079 - DNA, 3374 bp, Homo sapiens
  misc_feature (9)..(9): n is a, c, g, or t
tgagcacgngctgcgcacgctcaacattggacagtgtgtggtatcatctcaccaaagtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294080 - DNA, 2690 bp, Homo sapiens
cttgttccaaatgaggaagaagtgttgtttgatcagtcatggttggcatggttcaacgggatccactgaatcaggactatcaggcccacccattgatacatgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294081 - DNA, 2790 bp, Homo sapiens
  misc_feature (181)..(181): n is a, c, g, or t
tcatagctgactcatctatgtttgttctgctggcctccatcactgactcctggaggcggcttggctcttcaataatgggctcatcgataacatcaccctcttgtgattcgttttaagtgtaattccataatgagcagaggtgtacgcgaaattgtgttatgactgatagccttcagctacnaaaagataggactggcctggtttaaagtgttctattttgtaaatcattccatttgagtctttctgatgaacttggctataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294082 - DNA, 3647 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294083 - DNA, 2165 bp, Homo sapiens
gcacgagcgctgctgatgctatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294084 - DNA, 2165 bp, Homo sapiens
ttaggatgaggaacgtcactatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294085 - DNA, 3705 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgtaaaaaaattttaaaaaaaaaa

SEQ ID NO: 294086 - DNA, 3882 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctgcataaactattacagcataaactattacagcataaactattacagcataaactatttagtcataaactctacaaataggagattaaaaacaaggtatgggatgcctgataacactacaacttcttttgaacctagaaaggtcaaaacactacgctgatgtcacggttctcagtcgcgcgagacacggaggagacagaggcgatgtccgtgtacagtagtaatgcagtgacatagttgatcg

SEQ ID NO: 294087 - DNA, 3684 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgcctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294088 - DNA, 1989 bp, Homo sapiens
aacagctattacagggatcagctttcaccgggagacactctcagcaggaacacgcatataatctgggagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294089 - DNA, 3493 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcaaacttctaaaactaggggtaccgactcgatc

SEQ ID NO: 294090 - DNA, 3190 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294091 - DNA, 1927 bp, Homo sapiens
acaagcttactgaaaacattcgttaggcgtcgcggggcccggtcaaggtatacattgaacatggtacatatgctgtatcctagagtacatcctgtgcttgatgtagctgctttggatgtctctatgcaataaatgaagcctcgaagatcgtaatccaccgattggggtttcgttgatatcattgattcgcaagaatgcggagatctcgtgaagggcacagtttagctggatcatatcatacaggatgttctctgcggcgcatgtctcgaatctcgacaaatcatcagtccgcacgctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294092 - DNA, 3007 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgcctgcctactacaaggacagactgatggtacgacgcagtcgtcactgtc

SEQ ID NO: 294093 - DNA, 3227 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagacgctgaaccttaatttaaaaaaaaaccattaaacctcttccttaaggagccctatatcagtttaaaagagggatatatgagtatcgatcatgacagatgccgctactacggacagacggggaatatgccctggccttattaagcagacgatgctgtaaactacggctctcgtattatgtaagtttagtacgatctcctccggcgccaccgttgaactatacggcagatctattcgtccgtttatgagaaatctccatagactatataagacatgtcaacaggcgtatgattcattgtaatttaggagtaccgagtcactaggtgaattgggaaaacttgaataccggttcctatattgtagttggaca

SEQ ID NO: 294094 - DNA, 1187 bp, Homo sapiens
cgagctcggtaccctactccagacaagttgaccgcaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgcctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294095 - DNA, 3426 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaacttctgctcaacttctcactcctcttgcacgcggacaacctgcacttagcactgggcttgctgctctctgctgcttctgactggacgaacacacatgcaccccacaggaacctcagcacagactgacttcttacaccagctctcacgcaaccagcactgctgctgcccaacctacttggctgcactgctaactacactgctctgacgctgcgcacgctcaacacagcctccactgcactctctctctactcctctacgcctctccctctccactctagcgtggcgactgtgacacacagcgcacaacacaccgcctggctcctggcagcacacacaagttgccccgtgcacccacgcctctctacactctctcaaacaccaccctacatgcgcctgcctacacgctcgcttctctggaacccacacgtcacagcacacactacagagagccaagagatccaaaaaaccaactgtccatcatgtctcccgattccgagtattaaagcgacgtggggtcgaaatttcgatatccccgtgagttttatacccgaactgtccttccccttttagggggacaattgcgcctagttccgtgcactatcaccaaagccgaaatgggggcttcaacaccccattcccttgtgccacgcaactctccaggtcctactctaacacggcctggttacacttctccccgaataaacactgggcacgccgaggcaacgcggctggggttactggccggtcacaacacttagggtttgcttttctaatttggaacctgtggggaatttaaagtcccccctttttccaaagggctttaaaccgataatcatcacacggggcaatttacgggggatcttggggaacctcctgtgggggcgtctcttcgacaccgacgggcgtgggtgtatgccctttgaaagtttggagtgtgggctcacgacacaagatgtttccagattcttgtcccccaagttttattggcgaagaagggtcttccctttattccgtgtggtgaatttggagaaacacccttttgtggggggcagtcttatatttaaccctgtggggaaaaaacatctcccttagaggttgccacaattttttaactcacgagagtcggaagggggcgcttaccccaaatcaaacag

SEQ ID NO: 294096 - DNA, 2295 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaacgcgcatccaagtctaggcgattagcagaacgccgtgcagtaccatagattcatgtctgcagatcgacttttaagcagacctcacattcctgctgtgatgagcagtgggaaacatgcgaaaccggtaa

SEQ ID NO: 294097 - DNA, 1892 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcaggggtcgacgcggccgcgaatttagtagtagtag

SEQ ID NO: 294098 - DNA, 496 bp, Homo sapiens
gtaccccctagttttagaagtttccatagcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294099 - DNA, 902 bp, Homo sapiens
gaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaataaaacaatcaaaattgaacaagaaatgttttgccactccaatattcct

SEQ ID NO: 294100 - DNA, 374 bp, Homo sapiens
gtaccccaatacgctgacctgcaccgaggccggcaacatggcttgcaggcgtggcagctcggcttgaatgcggtccacggtctcgacgatattcgcgccgggctggcgggagatcaccaggttgaccccgggcgtgtcgccggaccagggagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgta

SEQ ID NO: 294101 - DNA, 266 bp, Homo sapiens
agagggcctctggccaaaatttggctagcggcccattgggataagaagctaaccaaagcccatgtgttcgagtgtaatttagagagcagcgtggagagtatcatctcaccaaaggtatgtttgatgttgacatttttattcactttgttgattgtttattgatatgtgaaatagaacttctaaaacagtttttttaggtaggggcattggagtgcaaggaaaatccttagaaatgtttctttattatgtgaagtccttatcacctc

SEQ ID NO: 294102 - DNA, 603 bp, Homo sapiens
tggaaaaagagaagtacttgtgcttcaaggtattttgcatatgttatcaacctttctatgagaatataaacttaggaagttatacctacttatctccctctgatccctagataatttatgggtagctagatatttaagcttagcatttcttttctaggtgtggttgacctgcctgaggaaaatcgggaagcagcttataatgccattactttacctgaagaatttcatgactttgatcagccactgcctgacttagagtatgtgtcttcttttaaaaaaaattgttgacttggtctgcaataagcagtagtattagcttccaaatgtatagttttccttggaatgttttacattaacagctaaaatgcatatatatatttatataggatagtatataaatatggaacataaaacctagaaagttgttcttctgtaagaaaatcatgtggatgtcagctttaacacagctaagatgtgagagttttgacaagcttaggccaaagcttacgtaaactgaaacagatacgcttgttatataatgatagcagggaatgtaaactgttgcttcatgatatttttcagagttatatattaaagtcagct

SEQ ID NO: 294103 - DNA, 226 bp, Homo sapiens
acattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgtacttttttgagtattcattattcagttggtggtggtccccaagggaaagttggctgaaaaag

SEQ ID NO: 294104 - DNA, 1083 bp, Homo sapiens
acgcaggtatgtcttcattatttaaatggtcaagtgctcttaaatttaggtagaagcatttgcctatacactctgcctcaccatttggttgtcattcctcttgtggcattaattgaattattggttttaaaataagatagaaactaatggaagttatatctttatggagactggaattttgaaatggattttgatcatttgttttattatttattattgtattcttttgtttttttccaacggttttgcagatatcagatgtgaatgtttaagatgtatttatttagataaatgacagattttatttttcaaaatagttgtctccgaaggagctatatgtgagcagtaaaagtcaaaggaccagattttatggctgaatgcaataatttatgagaaagaaacttacaactacattaccttttcaggtagtatgtatggtgtttcagagattcttaaaagtggagaaaacagtctgttgctttcaattttttaaatcttctcaatgttttagttttttgctctatgtactatacttttttaatagcagtcactgaactcacccctctcagttatcggatctttgttggttgtagtgcacacataataagttgttatggtgtatttctctttgtgtaggtgtccgccaccatggttcatttcacaaattaattttcatcacttactttgaagatttttaaattacttcatacatgcatacagttcagaaaaaacctcaaaccttgtataaaggtatacactgagaaactttgttcctctcctgctggtaacaatttttattagtttttatttcttcctagcttctttatgaataaaagcattgtgcttcttccattttacactactgctgacaatataaagtaatattttaccgcacagttcaatccattagtgataaatggtatttcagcatagtttttttgcattttcttatgaatgacattaggaatctttttttatatatttaagcacacttgttaatttttctgtgaactggttgatcatgttttttccattattttcaactgggttattcaattgtctttgatttctagcgctttttgt

SEQ ID NO: 294105 - DNA, 1323 bp, Homo sapiens
  misc_feature (189)..(189): n is a, c, g, or t
acattttctaatgtttacagaatgaagaggaacagtttatctgttgagaataaaattgtccagttgtcaggagcagcgaaacagccaaaagttgggttctactcttctctcaaccagactcatacacacacggttcttctagactgggggagtttgcctcaccatgtagtattacaaatttttcagtancttcctttactagatcgggcctgtgcatcttctgtatgtaggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctgg

SEQ ID NO: 294106 - DNA, 768 bp, Homo sapiens
ctgcgccgaccggacggccggactccagcaccttggcccggcccgcgaacgctgagcacgcgcggaaaccctttaaagataggaagtgaaatcaaatggaggttggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatgatgggttacattttttaaagctagaatgatatgatatttttattacaataactataaagatgcaatttccttttgaaaattatatacctatgaagcataaattatttaagttttttcaaaagatttcttaatctgcaaggtaggtatagttatagtaagtttctcctgagatattttaattttacatatatacatatgcttttcattatat

SEQ ID NO: 294107 - DNA, 1239 bp, Homo sapiens
ataatcatcttaaactggaaactgcccaaaagtccatctgaggaagaatagataaatagatgaaagtatacgcatataatggaatatcatgcatcagaaagaacgtggatacaaaaacataaactgcataatcacgatgtggaatgaaagaagacccaaagagtgcatgctgtttaattctatttataccatttttagaaacaggaagaactaatacatggtgttagaacttgagatagtgattatcttgctgggaataatgactaagtggtagcacaagggatctctgggatgtgggtgatgttctttttcttgatctgggtgctgattacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaaccacatgggccacaggaaggaatgcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 294108 - DNA, 1185 bp, Homo sapiens
ataatcatcttaaactggaaactgcccaaaagtccatctgaggaagaatagataaatagatgaaagtatacgcatataatggaatatcatgcatcagaaagaacgtggatacaaaaacataaactgcataatcacgatgtgtagaaacaggaagaactaatacatggtgttagaacttgagatagtgattatcttgctgggaataatgactaagtggtagcacaagggatctctgggatgtgggtgatgttctttttcttgatctgggtgctgattacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaaccacatgggccacaggaaggaatgcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 294109 - DNA, 1731 bp, Homo sapiens
ctgcgccgaccggacggccggactccagcaccttggcccggcccgcgaacgctgagcacgcgcggaaaccctttaaagataggaagtgaaatcaaatggaggttggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtcaaatatttgattgtttgcaaactgtcgtgatggattgctgcagaaacatttggaaaaaaataagaaatttgaaaagcaagaaattgctgtaaatagggcacaagccctgtatatggattagatggtcgatatgccaaaaactacagatggtttctaagtagatttctcacctttccttggaggcatattgtagcttgctaaattgttaagcaaaaccacatgggccacaggaaggaatgcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 294110 - DNA, 678 bp, Homo sapiens
agatggggccggggtttcaccatgttacccaggctagtctcaaactcctgagattacagacatgagccaccatgcccagcagtctttttcaattttttttgtgattctaagaagtttcggacaaggggaaaaatttaaaagataaaagttcattttaaaatatatgttttttttttactgtacatgggtttttttctgtaagatttaccaaacatcttgcctgcatttgtactttatatgtatcgatgtgaatgtgcctatcttgaaatattaactatagccagagattgtttttcttaattgagtatcatctccttcctttttatctccagtaaaacttcacttagaaaaataaattgaggccagggcgatggctcaggcctgtaatgccagcattttgggaggctaaggaaggtggatcacttgaggtcaggagttcaagaccagcctggccaacatggtgaaatcctgtctttactaaaatagctgggtgtggtggcgggtccctgtaatcccagctactcgggaggctgaggcaggagaatcacctgaacctgggaggcagaggttgcagtgagccgagattgtgccactgcagtccagtttgggtcacagagtgagattgtctcaaaaaaaaaaaaagaaagaaagaaagaaagaaaaagaaaaacaaaaaac

SEQ ID NO: 294111 - DNA, 1899 bp, Homo sapiens
acagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggacagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggccaagtttctttcccaagaccaaattaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294112 - DNA, 1727 bp, Homo sapiens
acagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggacagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294113 - DNA, 1868 bp, Homo sapiens
acagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggacagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294114 - DNA, 954 bp, Homo sapiens
tttagaaataccataagatttacaccaggcggggaataactgtgggtcccgagtgaggtgcccacattagttaacccctgcgtgtatatgttattcaatcccaagcctctccctggttcattaattttcctggaacattacaaccctgccacgtactggtccaagtggcgaccttcctcatatttaggacctaggtgatcaaccggcattgctccattccatagcactgtgtttcattccacaagttaatctaagccctagtctaccgtatctgcagctaaagatctttcccctccagcaattactacttgtaggttacaggtgccattgtaattatacccattcattttacccttttcgttgtttgacactatggtcataactcagctcatttatcactagcatctgtatagtatctcgcgagtgtgaatgctaagagcaccgtcggcctgtcgtataaacaacacgtacgggagctagagtgaaccagcgtggaatttcaggaatgagccttgaacccaggaccaggagtaaggtcacagccctgtcctcgggtagaggtattgaatcggcacacattaataggatcttagactcttggaccactcgaatcccttcaatgagcagggagtaccgtgaatgacgacgccccatggttctcatgaccattccacaccacacccgtgtgtttttggcaagttatatttgcagattcctgttaggcaaaatgagattcataaaacttcgctttaacaaccactaggtgggactattcagtgatagaatatagacataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatct

SEQ ID NO: 294115 - DNA, 1718 bp, Homo sapiens
aagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctgtattttcaacaatgagaacacatacagcttttcataatcagaaacaagttttatgttttgttttgctttttctaagaaaaaaagtagtttcagagcctggggttgctgtttgcattgggggctggacactcaggaaggagggactggcgcaggggaagggcatccgctgggaatagcacttgacccggagcccataggctgctgctcagtctcaggtcaccagcttcctcatctcaggggggtcaccaccatctgctagggttaccagaggccccactagaggatgcctgcagttgcgctgggagcccaccctggggcaggccacgctgggcccaggtgggcctctgaaagcctgcagcctggcggtgggttgctcagtggtctgatacctgagatcccccatgtccagctccaaaggggtggtggtttccttgatttctgtcccctccaaacaggaagttgtagtccagggaagttttgatttcctgcagttacatcccagccagggcccgtggaggaggggctgggatggagactgcagtgaggggaaggcaggtgagcagcccagcctgcgactgaggcttgagaccccaggtgggggtgctgatccatcctggtaagatgtactgtggtggctgtcaaaggtggaatgcacacatggacctgtttccctccagttcagggcaggagggaagcgctagaagggagcagaggagcccagtcctccatctgtggttgggaacccactttcttgagctttggggtgatgataagcatcgtcactgaggacgttgctgaaatgaagaatgtccagtccagtgaggggcctgtcgtgggaactcggtgggaggggatgcatcctcttcactgtgaccactgccacatcctggcattccctggtcagttgaccttgaaccggctgtgcaggtccagcaggaggccagctggcttcctaggagtctttttccctctgctcactctgctgtgtttgcgggtttcctagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294116 - DNA, 914 bp, Homo sapiens
gaatttcagacaaacaacaaatacttttccaatagaagtatatgtcctatgcaaaatttggggcatacaataaaagtatattcagtgtttatctgaattcggtttaacttggcagtcctgtattttcatttgctgtatctagcacccttgggaggggagagagggatggagggagtaggcaaaaggaaggggaaaagagggagaagagactaaggatggggagggcggcatgggcggagagtgaccagacgctgctgaccctccctctgggccgtgtgcagagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294117 - DNA, 768 bp, Homo sapiens
  misc_feature (19)..(19): n is a, c, g, or t
  misc_feature (31)..(31): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (59)..(59): n is a, c, g, or t
  misc_feature (76)..(76): n is a, c, g, or t
  misc_feature (78)..(78): n is a, c, g, or t
aaaggcaaggggctggagntaaaccggaggntccccggnggnaaaatntccactcgcgngccaatggcgaatgccnangtcagccacgggtagcagcgaggccagaatggcaagttctttccaagacaaattatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294118 - DNA, 1064 bp, Homo sapiens
agttcgatggcgaagttccgatgcgaagttgtagtccagggaagttttgatttcctgcagttacatcccagccagggcccgtggaggaggggctgggatggagactgcagtgaggggaaggcaggtgagcagcccagcctgcgactgaggcttgagaccccaggtgggggtgctgatccatcctggtaagatgtactgtggtggctgtcaaaggtggaatgcacacatggacctgtttccctccagttcagggcaggagggaagcgctagaagggagcagaggagcccagtcctccatctgtggttgggaacccactttcttgagctttggggtgatgataagcatcgtcactgaggacgttgctgaaatgaagaatgtccagtccagtgaggggcctgtcgtgggaactcggtgggaggggatgcatcctcttcactgtgaccactgccacatcctggcattccctggtcagttgaccttgaaccggctgtgcaggtccagcaggaggccagctggcttcctaggagtctttttccctctgctcactctgctgtgtttgcgggtttcctagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgat

SEQ ID NO: 294119 - DNA, 3543 bp, Homo sapiens
aagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctgtattttcaacaatgagaacacatacagcttttcataatcagaaacaagttttatgttttgttttgctttttctaagaaaaaaagtagtttcagagcctggggttgctgtttgcattgggggctggacactcaggaaggagggactggcgcaggggaagggcatccgctgggaatagcacttgacccggagcccataggctgctgctcagtctcaggtcaccagcttcctcatctcaggggggtcaccaccatctgctagggttaccagaggccccactagaggatgcctgcagttgcgctgggagcccaccctggggcaggccacgctgggcccaggtgggcctctgaaagcctgcagcctggcggtgggttgctcagtggtctgatacctgagatcccccatgtccagctccaaaggggtggtggtttccttgatttctgtcccctccaaacaggaagttgtagtccagggaagttttgatttcctgcagttacatcccagccagggcccgtggaggaggggctgggatggagactgcagtgaggggaaggcaggtgagcagcccagcctgcgactgaggcttgagaccccaggtgggggtgctgatccatcctggtaagatgtactgtggtggctgtcaaaggtggaatgcacacatggacctgtttccctccagttcagggcaggagggaagcgctagaagggagcagaggagcccagtcctccatctgtggttgggaacccactttcttgagctttggggtgatgataagcatcgtcactgaggacgttgctgaaatgaagaatgtccagtccagtgaggggcctgtcgtgggaactcggtgggaggggatgcatcctcttcactgtgaccactgccacatcctggcattccctggtcagttgaccttgaaccggctgtgcaggtccagcaggaggccagctggcttcctaggagtctttttccctctgctcactctgctgtgtttgcgggtttcctagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgatctcttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatct

SEQ ID NO: 294120 - DNA, 3693 bp, Homo sapiens
acagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggacagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgatctcttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatct

SEQ ID NO: 294121 - DNA, 206 bp, Homo sapiens
aaaattaaatgtgatttattgcagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggag

SEQ ID NO: 294122 - DNA, 532 bp, Homo sapiens
cccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggtgagtgtgagggtctgtgtcggcctggccagggctgggggcgtgaacctcaggtggagccctcccctgactgttttcctttctctgctgcaggccaagtttctttcccaagaccaaattaatg

SEQ ID NO: 294123 - DNA, 408 bp, Homo sapiens
ctcagtactgtaaaagggcggaaacagacagagatgaaaactcactatgctgcccagactcgtctcgaactcctgggtgtcacgcgtgtccgtatagaagaccacctaaacaggctttgtgttcacgtgttgaaatcctaactccaaatatgatgataggaggagatggggccttcgggaggtgatgaggtcatgagggtggaatcctcatgaatggtctcaacgcccttagaaaagagaccccagagacctcgctcccgctttctactgtgggagaatgcagcaagaagtcagccgtctatgaacaaggaagcaggtcctctccaggcactgaatgtaccagtgccttgatcttggacttcccagcctccagaactatgacaataaattctgttgtttaagctacat

SEQ ID NO: 294124 - DNA, 1424 bp, Homo sapiens
  misc_feature (3)..(3): n is a, c, g, or t
ggnaagcaagggccctacacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtcaagctcccagcatccctcccggacccggccctcttcagctcatcgcccgaggattttccgcctctgccctcgtcggcagatcctgctcctacccactccctagctgtgttcccgcggggagagaggggaaagagggtctgattttttaacgaagggaaagaaaatatgccatttctagcgcttcagccacacaaagaaagcggcggaatgatccgctctcggcgaccgcaagtcccggctcgcccggcgcctgcgcggcagcgggggtgggagctgcggacggccatgtgcgcggcggagaggccgggtggccaccgaaccttcccgcctgttctgcggtgggtaggagtttggaaactaatgttcctgtgctaaccttcgtgtctctgtgacatgactgttgaaagacggagagtgcggaatctttggagttttaagcttgccaactgtgcggcctagcagaatcctgggagacggaaggacagccaagaggctaggatttacctttaagtgtccctagattcaactaggcagactgggacgggagacgctgtgaaggtaccagggaaggaacgagtgaggttccttttccactttttcataaactcaacagtcaggttcatgacgaagatatagatatttctgtagattttttccccaacattctaattatgcctcatgtttcgtagatcctagtaactgcttggattactgccacctcagaggtagagatctgtttttccgtggctggaatgccaaaaattttgttgtattttattaagaaagtagcaaaagtttggagatttgcaaagttaaaaaaaaaaaaagcattatgaacttaatctagatgtgatttgctaaggaacttaatatattgatatgtttttcacaggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccata

SEQ ID NO: 294125 - DNA, 1387 bp, Homo sapiens
  misc_feature (3)..(3): n is a, c, g, or t
ggnaagcaagggccctacacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtcaagctcccagcatccctcccggacccggcccctcgtcggcagatcctgctcctacccactccctagctgtgttcccgcggggagagaggggaaagagggtctgattttttaacgaagggaaagaaaatatgccatttctagcgcttcagccacacaaagaaagcggcggaatgatccgctctcggcgaccgcaagtcccggctcgcccggcgcctgcgcggcagcgggggtgggagctgcggacggccatgtgcgcggcggagaggccgggtggccaccgaaccttcccgcctgttctgcggtgggtaggagtttggaaactaatgttcctgtgctaaccttcgtgtctctgtgacatgactgttgaaagacggagagtgcggaatctttggagttttaagcttgccaactgtgcggcctagcagaatcctgggagacggaaggacagccaagaggctaggatttacctttaagtgtccctagattcaactaggcagactgggacgggagacgctgtgaaggtaccagggaaggaacgagtgaggttccttttccactttttcataaactcaacagtcaggttcatgacgaagatatagatatttctgtagattttttccccaacattctaattatgcctcatgtttcgtagatcctagtaactgcttggattactgccacctcagaggtagagatctgtttttccgtggctggaatgccaaaaattttgttgtattttattaagaaagtagcaaaagtttggagatttgcaaagttaaaaaaaaaaaaagcattatgaacttaatctagatgtgatttgctaaggaacttaatatattgatatgtttttcacaggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccata

SEQ ID NO: 294126 - DNA, 1090 bp, Homo sapiens
  misc_feature (3)..(3): n is a, c, g, or t
ggnaagcaagggccctacacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtcaagctcccagcatccctcccggacccggccctcttcagctcatcgcccgaggattttccgcctctgccctcgtcggcagatcctgctcctacccactccctagctgtgttcccgcggggagagaggggaaagagggtctgattttttaacgaagggaaagaaaatatgccatttctagcgcttcagccacacaaagaaagcggcggaatgatccgctctcggcgaccgcaagtcccggctcgcccggcgcctgcgcggcagcgggggtgggagctgcggacggccatgtgcgcggcggagaggccgggtggccaccgaaccttcccgcctgttctgcggtgggtaggagtttggaaactaatgttcctgtgctaaccttcgtgtctctgtgacatgactgttgaaagacggagagtgcggaatctttggagttttaagcttgccaactgtgcggcctagcagaatcctgggagacggaaggacagccaagaggctaggatttacctttaagtgtccctagattcaactaggcagactgggacgggagacgctgtgaaggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccata

SEQ ID NO: 294127 - DNA, 870 bp, Homo sapiens
  misc_feature (3)..(3): n is a, c, g, or t
ggnaagcaagggccctacacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtcaagctcccagcatccctcccggacccggccctcttcagctcatcgcccgaggattttccgcctctgccctcgtcggcagatcctgctcctacccactccctagctgtgttcccgcggggagagaggggaaagagggtctgattttttaacgaagggaaagaaaatatgccatttctagcgcttcagccacacaaagaaagcggcggaatgatccgctctcggcgaccgcaagtcccggctcgcccggcgcctgcgcggcagcgggggtgggagctgcggacggccatgtgcgcggcggagaggccgggtggccaccgaaccttcccgcctgttctgcggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccata

SEQ ID NO: 294128 - DNA, 742 bp, Homo sapiens
tctcatgctggatgcttcctgaccttgaacatcagactccaagttcttcagttttggaacttggactggctctccttgctcctcagcctgcagttggcctgttgtgggaccttgtgatcgtgtcctgcagagcaaaagaggagagagaaaaagagaatgagttacatgggcccactgtatgttatagctgactgctgatggtatcagagagttttatggttttgtgtccagcattggttccttctggtgggttcttggtccctctgacttcaagaatgaagccacggaccctcacggtttcagaatcactggaccattagaccacatcagcactggacccagctaaagggcagagattcagagatccccaactgtgactagttgtgcaagaagcatgcagaatgatgagaaacctacagctcagaaaagaaacaaatcgtctatatggaagtccagtcttgctgtggaaaggctcagaaaaacaagacccttagcatatctcagggaactgaaaggctgtggggaaaccaacagcttgctgcaaccacagccacaagtcaggtaagcattgagcctgacagctcaggaaaatgacccacttcttgccaactcagacaaaaaggcttcacttaggcctagggaaactgtctctaataaggccatctgttaaccgtgtcgcctgagtccctctcagcaattcctcattccctccctttccaccttccaccctgaagccagacat

SEQ ID NO: 294129 - DNA, 862 bp, Homo sapiens
cgagaagatctgggaaggagtcagtcagagagccttgggccagagttccaggggctctgggagtggctgccaggtcctgcagagcaaaagaggagagagaaaaagagaatgagttacatgggcccactgtatgttatagctgactgctgatggtatcagagattttaacactgcagtcaactgcagacaaagccgcaatcttgtgacttcacagagcctcatgggcttttgagttgaccaacttgagaaaaatttctgacttgatgcatgaaatgaaacgaaggcaggtgacacataaaggaaatgacaagacacgattgaaaactattgaccctcaagttatcacaaatggttatgaaatggaaatggaatgggaaggagtatgaaaaaataagctgaatactgacaaacctaaggtttcagaatcactggaccattagaccacatcagcactggacccagctaaagggcagagattcagagatccccaactgtgactagttgtgcaagaagcatgcagaatgatgagaaacctacagctcagaaaagaaacaaatcgtctatatggaagtccagtcttgctgtggaaaggctcagaaaaacaagacccttagcatatctcagggaactgaaaggctgtggggaaaccaacagcttgctgcaaccacagccacaagtcaggtaagcattgagcctgacagctcaggaaaatgacccacttcttgccaactcagacaaaaaggcttcacttaggcctagggaaactgtctctaataaggccatctgttaaccgtgtcgcctgagtccctctcagcaattcctcattccctccctttccaccttccaccctgaagccagacat

SEQ ID NO: 294130 - DNA, 402 bp, Homo sapiens
tctcatgctggatgcttcctgaccttgaacatcagactccaagttcttcagttttggaacttggactggctctccttgctcctcagcctgcagttggcctgttgtgggaccttgtgatcgtgtcctgcagagcaaaagaggagagagaaaaagagaatgagttacatgggcccactgtatgttatagctgactgctgatggtatcagagattttaacactgcagtcaactgcagacaaagccgcaatcttgtgacttcacagagcctcatgggcttttgagttgaccaacttgagaaaaatttctgacttgatgcatgaaatgaaacgaaggcaggtgacacataaaggaaatgacaaggtattttttttttgccaaggagtttgcttctcacaaagtttct

SEQ ID NO: 294131 - DNA, 7094 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaaa

SEQ ID NO: 294132 - DNA, 6464 bp, Homo sapiens
tcgcggccgcccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgagttggaccaggaccagcatggccgactcaaggacctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaaa

SEQ ID NO: 294133 - DNA, 6745 bp, Homo sapiens
tcgcggccgcccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgagttggaccaggaccagcatggccgactcaaggacctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacaggccttgctaccggagcagcgagcagtgcacgcagattcctacagaaggattgggcacctgtgaaaactgggctgctattgatggcatttcttaccatggcagacagatgcacacacccacccatgcacacacaccacacacagagacataagctaagatatgttggaattaagtgctcttttaaattattttattatttttactgttaaacctttgcagtattatgtctcttatttatttatgtagaaatgacagatcttgtgaatcaaattcacaaacatcagcttgttacaaatcattttatttataccctttaaagagtgtggatttaagattcttgaaaggatgtagtctatatattttctcattccatatgttgtaactatttttaaccaaaggtactacttttatatatggaatttgaagaaaaccaggggtatttatactgttttgtataagatgtacaaatctttttgacaggaaatttttgatgaaacaataaaataaattttaagtataaa

SEQ ID NO: 294134 - DNA, 422 bp, Homo sapiens
tgcgattatcctatagatcagtagaagaagttgaggctaacagcggtggcattgagcccgaacacggtaaacacattcggacaggctgtagataaagcctttactcttgtttttagaaacgtggttcaatataaaattgcaaagctttggcaacttgaaaaaaagaaaaaaaaaaaaagaatttggccatactcttttcttgagctgtttcacttgtggtctcgtttttcatttgtccttgaagtttttatgagaacatttccatctgattttgatatgcgtcaacaaaggaatggaagaatcaaaccacaagggtatttgctttgttaacaaaacaaacaaaaaactggctgcaaatctgggaatccaggccttgggagtgttagaattcagacactgatctatagctgtcctcttcgaag

SEQ ID NO: 294135 - DNA, 935 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactgaactctggtctctttttttactgtgatttgattaactattacggtagttgtg

SEQ ID NO: 294136 - DNA, 712 bp, Homo sapiens
aaattgtcttattattgagctataatagtctttatatattctagttacaagtcccttatcagatacttaatttgcaaaacatttctactttcttgatagtgtcctttgaagcacaaaagattttgttttgatgatatccaatttatcttttttgttgttgttgttgcttatgcttttggtgtcacatctaagaccagtgttggtttttaaatcccaggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacggtaaacacattcggacaggctgtagataaagcctttactcttgtttttagaaacgtggttcaatataaaattgcaaagctttggcaacttgaaaaaaagaaaaaaaaaaaaagaatttggccatactcttttcttgagctgtttcacttgtggtctcgtttttcatttgtccttgaagtttttatgagaacatttccatctgattttgatatgcgtcaacaaaggaatggaagaatcaaaccacaagggtatttgctttgttaacaaaacaaacaaaaaactggctgcaaatctgggaatccaggccttgggagtgttagaattcagacactgatctatagctgtcctcttcgaag

SEQ ID NO: 294137 - DNA, 303 bp, Homo sapiens
tatatgtatccacgtccattactaaattaattctatgtagagtgttggcgctatgggaacacaggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaaa

SEQ ID NO: 294138 - DNA, 471 bp, Homo sapiens
gggtgtcagctgccaacaagtagctcgggtgtctgggccgctcctgaatggtcacaagctgacacactgtcttctgataaaagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagtgtgataaagcagctcgaacacttggtttttgcctcaagatactgagcctggggtgctttccagtgcccagcagttgccatggttctttctgctggattccttgcacccaggcctgtctcgttctccagcatgtggagagtcgccagcctccctcatcccccatcttttcattttgcatattgccataatctaccaataaaggaggttcagtaacatt

SEQ ID NO: 294139 - DNA, 489 bp, Homo sapiens
gggatataatttactaagttggttatgaaggagaacattgcctggcactgagaaatgatccctgtgttcattgaacacgtcactctagtgcgttctccccatcacccagttggtgttgttcgtgcttacatgtcacattcctatcatactcaagagactgggtgaataccagaaactgggcctttgctgtgttgggtcaaagaagggcactcgggaaaaatgacagctttgcccttttccccttctagtttggtgacctcgatcctagcagtgctgagttcttcctgcaagaagagagactgacacagatgagaaatgaatatgagcggcagtgcagggtaggtagacaaagagaactgagtaagtgcaggagtgcctgggttcagaccccagcttccccgttccctagctctgtgaccctaagcaagtcacttcatctgtgggtacttccattcctcatgcataaaatggtaaaaataaaagtaccca

SEQ ID NO: 294140 - DNA, 396 bp, Homo sapiens
ggcagctaagaactgagattctcatgtcatgtggcctcaactcttgtctcctctctcagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgaggtaaggaatcgggcatgcacgttcatctggatcatgagtgtggagccccacgtcagtgcagcacagagacaggggagctgagggggttgatggcacgatgtgggcttttctcagttaccaactccttgctaatcttattacttgccttttggacatatataatgttt

SEQ ID NO: 294141 - DNA, 10252 bp, Homo sapiens
tcgcggccgcccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgagttggaccaggaccagcatggccgactcaaggacctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294142 - DNA, 8512 bp, Homo sapiens
tcgcggccgcccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgagttggaccaggaccagcatggccgactcaaggacctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgt

SEQ ID NO: 294143 - DNA, 10882 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294144 - DNA, 9901 bp, Homo sapiens
ggcagctaagaactgagattctcatgtcatgtggcctcaactcttgtctcctctctcagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294145 - DNA, 8743 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294146 - DNA, 10943 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagaactcagtggttggaagtagcagagaagggtgcagttctctgcctgagatagtgtgtgaagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294147 - DNA, 6517 bp, Homo sapiens
tcgcggccgcccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgagttggaccaggaccagcatggccgactcaaggacctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaaa

SEQ ID NO: 294148 - DNA, 5270 bp, Homo sapiens
ctgaagggcagtgatcgtattgggtcatagcagttcctagagtgacactgcatatcggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294149 - DNA, 5156 bp, Homo sapiens
gtgctttggattctaaaaaaaggatatgattgcatatgtgaaaatgaaagtagagtttagcctgtgaaagcttttgagttggcagtgcatttcagccttctcttttgtcctctgtgaatcaaatgaatatcttctgggcttaaagataacttcgtaagaatgaagcaacttttaagccaccagtctcaatgcatttgggtcctttatggaactgggccttgccctacagtcatattcattattggacatgacatggctgttttgtcaaagaccattttaaacagagactctccaaatctttttgtttaaatcaaacttcaagaatattgttttattcatatttatatgtacatacacatactttcattagaagactgaggggacaattgaaaggtacttattaggagtcgttgtcattgggtaaacatgacacctgtctcaaaccagcaattacccaatagcttgtttttaaggcttacactctgcaattctcttaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294150 - DNA, 5185 bp, Homo sapiens
accatcttccaccctcaaaacatgaggcaatagaaaagaaaaataggaaatttccaaaaagaagcaactcctcaaaattagacgtgtaaaacagtctttggtttgtctcgatttggagccaggaagaccatttcctttgaccttgccctgctcccctacataaatagatggtacttgttcttgacaatgtaagtgcaggcatataaattaaggctagctatgtttgcaaaaatgccctcttacctctttttcccttcctgaaacagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcaattggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294151 - DNA, 4283 bp, Homo sapiens
tttatatcagggggatgatggtaacacaggtaagattcttttgatttttcagtctgatcctttatctgatagggttacttttctgacatatgcaatccatgcagggctcaaaactctcatttcatgagaaatccatccttcctgttacaaaggcaaaacatttgctgtcctttctctaggcatcttgtggggaaaataaaccagtgttttcagtgtgacatgattttcgaataatatacttttcttcccttcaggggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatcattggt

SEQ ID NO: 294152 - DNA, 6134 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcacgaattgttagtcgatctttacgtacggcatgtctagggcttacgtataact

SEQ ID NO: 294153 - DNA, 6084 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcaggtatggcctgtagccacctgacagctttttttgaggaaatcccaagaaatagaagaaatgtttgtattaaacttccttaaacataaagccttagtaattaaaacagtatggtcctggcacatgaatagataagtaggtaagtggaatagaaagtctagaattagacccaaatacaaatggaaacgtagtgtataaccagggccacttctcaaaccactggggtaaagatggacttttaaattaatggtgcctgaacaactgagtagacattcggaaatagataaaattagacctatgtttcattccatgcacaaggataaacttaattggattaggagactaaatataaaaaaaaaaa

SEQ ID NO: 294154 - DNA, 2906 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacggtaaacacattcggacaggctgtagataaagcctttactcttgtttttagaaacgtggttcaatataaaattgcaaagctttggcaacttgaaaaaaagaaaaaaaaaaaaagaatttggccatactcttttcttgagctgtttcacttgtggtctcgtttttcatttgtccttgaagtttttatgagaacatttccatctgattttgatatgcgtcaacaaaggaatggaagaatcaaaccacaagggtatttgctttgttaacaaaacaaacaaaaaactggctgcaaatctgggaatccaggccttgggagtgttagaattcagacactgatctatagctgtcctcttcgaag

SEQ ID NO: 294155 - DNA, 1482 bp, Homo sapiens
aaaactcagagtgagactaagagctaccgcaacactgaaaatcctggagcaccttggggattctcagcagatcttagttgacaattaactggtggactctaagtgaatcttgttagcgaagtgttggccttgtctaaattcttaactcctgtggctttgcataacaacttggtgtttcttttctgaggctttgatgtttatataacactctcaacttattttgaaaacatttacatagtgattagttaacccaacagaccaatcctgggaagacagccagagcctgcagcaccttagtaacagaaaaactgataattaggagaagagacctgtccaagaccaggaacctggaccaaaattgtgccatgttgctttactttaatgagtggccccagtaaaaactgagctgtatggcagagctgttcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcttttggagagctgacatttctgtgcatgcgtcatgtacacatttagagttcagtgtgataaagcagctcgaacacttggtttttgcctcaagatactgagcctggggtgctttccagtgcccagcagttgccatggttctttctgctggattccttgcacccaggcctgtctcgttctccagcatgtggagagtcgccagcctccctcatcccccatcttttcattttgcatattgccataatctaccaataaaggaggttcagtaacatt

SEQ ID NO: 294156 - DNA, 473 bp, Homo sapiens
gaatttccaacactatgttgaataggagtggtgagagagggtatccttgtcttgtgccagttttcaaagggaatgcttccagcttttgcccattatgatactggctgtgggtttgtcataaatagctcttattatttggagatacgttccatcaatacctagtttattgagagtttttagcatgatgttgaattttccatgccatttaagtggaaagtcttttacgataaaaaatggtcataaaacagtgtcattgagttcatattactgtttccttaatatggccttttatgaacctggtaagtttccccagcctaaatatgtatgtctgttatttgactttttcatttttctcttagtcctccactttagtgtcttctctggaggcggagctctctgaagttaaaatacagacccatattgtgcaacaggaaaaccaccttctcaaagatgaactggagaaaatgaaacag

SEQ ID NO: 294157 - DNA, 365 bp, Homo sapiens
ccgtggaggagtttcctgaagtgacggtgattgagccactggatgaagaagcgcggccttcacacatcccagccggtgactgcagtgaggtaaggaatcgggcatgcacgttcatctggatcatgagtgtggagccccacgtcagtgcagcacagagacaggggagctgagggggttgatggcacgatgtgggcttttctcagttaccaactccttgctaatcttattacttgccttttggacatatataatgtttctatcttttgaatgtttttacctcgtttcagcttttggagagctgacatttctgtgcatgcgtcatgtacacatttagagttcaggtatttccacatcatctgaggtct

SEQ ID NO: 294158 - DNA, 185 bp, Homo sapiens
tcacatcactgcactccagcctgggtgacagagcaagacaccatctcaaaaaataatgatgagaatgatttgagacctttcttcttttctaagaaccttcccaactggagatgtgaaacggtcattctccatccactcacctggtttcctgcctctatgtcgttttcgggatcctctagacaccc

SEQ ID NO: 294159 - DNA, 2950 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgaaaaaaggg

SEQ ID NO: 294160 - DNA, 1287 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtggtggcgaatatccaactctcttggtactacatactggaccggttgaaattcaactaaagaagtatagtggattccattccattatgaagcatgtctactgattggagtcagagaccggggtaacacaaacagtgaaacaacttagtaatatataaagtaacaccctgaaagcagtacttaaacaaccaagtaagaagtagtcaacaaattcaaaaaggatc

SEQ ID NO: 294161 - DNA, 489 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacggtgcgtggggtgcgccgcgggcggaggggcgtggcgagtggacggtatgtcccacgggaaccgccaggcactgacggcgtggacggctgccaccgaggcgcagggcgggtgctgcgcgtctcactgctcggcgtttggcgttagcgtag

SEQ ID NO: 294162 - DNA, 3012 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgaaaaaaggg

SEQ ID NO: 294163 - DNA, 3039 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgaaaaaaggg

SEQ ID NO: 294164 - DNA, 2893 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgaaaaaaggg

SEQ ID NO: 294165 - DNA, 1996 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaatttgagtttgtccttgttctaggagttactgggtagttgtaagtataatttttattaaatataatgtaaaataaaatgttaagatacttagttttgtttttcaaagtaaagctgtagtcagcgttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgaaaaaaggg

SEQ ID NO: 294166 - DNA, 1260 bp, Homo sapiens
gcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtggtggcgaatatccaactctcttggtactacatactggaccggttgaaattcaactaaagaagtatagtggattccattccattatgaagcatgtctactgattggagtcagagaccggggtaacacaaacagtgaaacaacttagtaatatataaagtaacaccctgaaagcagtacttaaacaaccaagtaagaagtagtcaacaaattcaaaaaggatc

SEQ ID NO: 294167 - DNA, 2372 bp, Homo sapiens
caggactagagagcgagccgcaaggaagtcggtgcagtcgagacccccctccccatcccagcgcatcgcgtctccgccgagcttgagggcacgccggggacccctccccagagccggccggaccccaggtgccgaggccttggggagcgcggggcgtcccgggtcgcggtgccctcgggacgagacagcccctggcagtgccaccaccgcagccgccgggcgatctccaagcggcgatctctaagcgctgctctctgctcggccgcgggccaggaggggagggtccggccttgccccgcaggcgtccattggcggcttcccccggcctccgcgccatgccgcgggccgtgtgaaaggcggcagcaccggaacccgcaggtgtccgcgggcgcgccaagcccttttgggtagggggcgccttactcgctatgctgcaagggccccgggccttggcttcggccgctgggcagaccccgaaggtggtgcccgcgatgagccccacagagctgtggccatccggcctcagcagcccccagctctgcccagctactgctacctactacacaccgctgtacccgcagacggcgcctcccgcagcggcgccaggcacctgcctcgacgccactccccacggacccgagggccaagttgtgcgatgcctgccggcaggccggctgccggccaaaaggaagctggatctggaggggattgggaggcccgtcgtccctgagttcccaacccccaaggggaagtgcatcagagtggatggcctccccagccccaaaacccccaaatcccccggggagaagactcggtatgacacttcgctggggctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtaggcaggggaatgtttgaagaccccaccagacctgggaagcagcaacagctggggcaggagctgaaggagctgatgaacacggagcaggccttggaccagctcatccagagctgctctctgagcttcaagcacctgactgaggacaaggccaacaagaggctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtggg

SEQ ID NO: 294168 - DNA, 1473 bp, Homo sapiens
agatgaagcctttacataaggcaacattttttatgatttataatgtaaggcaacattttttatgatttatattcccatttgctttccaaagggatctaaggtagcttatgagattaacaggttacagattgtattatttctaagttgtacaaggagtgagaaagtaatgttcagaggcttaggagaggtgggtgaaggtgctccctggcaggtttggggtttgaattttgaccagacagtcacttttcttgactctcctgccctacgctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtggg

SEQ ID NO: 294169 - DNA, 469 bp, Homo sapiens
  misc_feature (460)..(460): n is a, c, g, or t
ttaggctggtggatttcatggagcatgtgaaaggagaagccatcctgggcgaggattttcacttctcttgttgaggcttttcaggaataggaatgctgatttccttagcacctcattctaaaggtattcccttgatgggtaagccccatgagaattcctacttttggttaatttctgattctttcaggtatagagagggcaaccgctcagaagcagcctaggggaaaaaaatatcttgtactttttggaatgaacatctttatacatagtgaaactcagttatggcactacttattacttggatttgaatgggtccccagaagtaatatttgataaatgccttgctaaataccatacaaagctcatgtggtagttcttttacccacattagcctaacatgttctactgtttataataataactcacaacccaatttctccagcctgggcgacagagcagntccgtctca

SEQ ID NO: 294170 - DNA, 2017 bp, Homo sapiens
atggcgccgccagccgcccgcctcgccctgctctccgccgcggcgctcacgctggcggcccggcccgcgcctagccccggcctcggccccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaatttttcttgcttctctatttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtggg

SEQ ID NO: 294171 - DNA, 1838 bp, Homo sapiens
atggcgccgccagccgcccgcctcgccctgctctccgccgcggcgctcacgctggcggcccggcccgcgcctagccccggcctcggccccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaaccggatagctgaagagatcctgtagatcac

SEQ ID NO: 294172 - DNA, 1966 bp, Homo sapiens
atggcgccgccagccgcccgcctcgccctgctctccgccgcggcgctcacgctggcggcccggcccgcgcctagccccggcctcggccccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaatttttcttgcttctctatttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtggg

SEQ ID NO: 294173 - DNA, 329 bp, Homo sapiens
atttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtgggcctccttcagcctgggagggtctgagaataagatctagtgacccccatttatatcaaacctgataccttacacatgggcttctttctagattcttctttccatagctcatggagctgcagggaaagctttaagagc

SEQ ID NO: 294174 - DNA, 340 bp, Homo sapiens
gaccaactattagaaataatacagaagctaaagcatttccttttctgtaaaactgaaaagcaatgaaccagttgaattaaaacatcagaagtcatcaattgtgtccttttccccaacagaaatccagatggagacgtgagcccctggtgctatgtggcagagcacgaggatggtgtctactggaagtactgtgagatacctgcttgccagagtaagactgtaatacccaatgtgatggtttacaggactgtgaacactaagagtgcgtagagggaggcccctgccagaggtcaggtagttaggctggtggatttcatggagcatgtgaaaggagaagcca

SEQ ID NO: 294175 - DNA, 527 bp, Homo sapiens
aggtccttcccaagaccttgccccaccccatttcatagatacagtatctcgtgagatggtaggttgtttgcgttgttctaatctattggaaaaaatatttatctgcttgacagatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccct

SEQ ID NO: 294176 - DNA, 2975 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294177 - DNA, 2947 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294178 - DNA, 673 bp, Homo sapiens
agtgaacttggtgttctttatgttgctcctttctgttttacctcagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294179 - DNA, 586 bp, Homo sapiens
ctacaattcttcccccggaatatttttgacattataattatgggctttgagggagatagtcaataataattttctcccatgtgtattttatacccatcaatcaatttttgatgagtgaagacatgtgttcttctcttcataatagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294180 - DNA, 1285 bp, Homo sapiens
ggtggtggtcccagtgtagtattgtacagtcaaaaaagtgtgaattttagagtcaggagatattccagaatcatttcactcttggctttctcatttacctggtttagttacccaacctttcaacttcaacttccttatccatatgatgggacaatatctgtcttatcctctgcacaaggtttttaagagggtgaaatgaagcaacattgataagacaaacaaatcctttgagaaaaagcaaaacttcaagcttgttcccttgcttgacctttgtactttttacttcatctgcctaaaaccctttcttcccaaataaccacatcaagtgttgttcaaatgtctgtttctcagagaggtcttctgtgattacctcatataaaacaggccccatcccccctgttattctctgtcccttctcccatattttcctttatcacacctgtcccacctgacacattacctatgtatttgtttatttgactgttgctttgcattaaaaaatacacttatggcagcaggggttttttcttgttcgctgctgtgactgtggtgcctagaacgatgccttacgtgtaatacatgctaccaaacgtttgtagtgtgaatgaatgactataaatgctaagatactaagcagctttgttagtaccagcttgaataagtcacttaacctttcctgtgtactgtttcataaccttgcctatgtgctgttgcataacctattgcttctactcactctgtaatgttccatctactctccgtccttccgcagtcatttgccaggaatcacagatgcaccacagagattttgctcattgagaaccctaatttttgagatgctttcctgttatcatggccccagctatatcttccagaaaacataaacatatttgggaagtccaacctgtgatattcctaggagataagatattttgtttcttccctttgaaaaatcattcttccacaagtcccttttgtgtgcctttgtttttctaaattgtgcactggacttcacctcctatagatgaaaattttctctttcttcaaacagatgactctggccactggggcagaggtggtttatttacagctctggaaaagcgatccgctgagccaagaaaaatatatgagctggctgggaaaatgaaaggtaagaagcaaagcagagggaaaggttaagggtggaataagagagaagaggacacctaagactgtatcgtgagggttacacagcactagataaggaattagaataaccagttgggaactgaattctgtcataaat

SEQ ID NO: 294181 - DNA, 3052 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaaaaaaaagacagaacaaaacagaaaaaaaaaagggggggggcacaaagataccgcaggggacgaataagagacacgaa

SEQ ID NO: 294182 - DNA, 3312 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaaaaaaaaaaacaaacaaacaaaaaaaaacctgtttggggcggcacgggaccataaaaaaagtcttcttagacccccatccggtatgaggagcccgcggggccccaagagagttagatggagacagctggccccaacaaacgagctcccccgagagagaaacccgcgggccaggaaccaggaggcgagggggaatctcgtcccccattaataaaaaacgcgccgggggcacaccgagacggtgtctagaaacacaactcccgagaagagaagaccgagagggacgcgaacgcggaacctataaaacgggagagccacggcagctactaaaaaaatgcga

SEQ ID NO: 294183 - DNA, 2363 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294184 - DNA, 2050 bp, Homo sapiens
gaggacacttcacttgggaaagaagagagcgcgaaccgaattgtagaagatgatgcaagcataagtagctgtaataaattactaacttcaggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294185 - DNA, 2092 bp, Homo sapiens
acagaacattttgtcccagcttcgaatatgggtgatccacacactttcgaagctgggacaaaatgttctgtagtttaactttctttgccgtctcattttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294186 - DNA, 2377 bp, Homo sapiens
  misc_feature (16)..(16): n is a, c, g, or t
  misc_feature (30)..(30): n is a, c, g, or t
gatctcccaggaagantgggagaacaacgntaccggatattgagaagatctgagtcagcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggtgacaccttttggccactacattacctaaggctctgttagacttaacagtccagataggtccatgaagaataatatgggatatgagaatattacaaaggaaagcagggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294187 - DNA, 2004 bp, Homo sapiens
acttggcagtgtttccttttctttttcttgccaggggccatcgggttttacttttctcccaaatgacccagatgttggatattctccaagactatatggattacagaggtgacaccttttggccactacattacctaaggctctgttagacttaacagtccagataggtccatgaagaataatatgggatatgagaatattacaaaggaaagcagggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294188 - DNA, 2660 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccaggttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294189 - DNA, 1777 bp, Homo sapiens
ggtggtggtcccagtgtagtattgtacagtcaaaaaagtgtgaattttagagtcaggagatattccagaatcatttcactcttggctttctcatttacctggtttagttacccaacctttcaacttcaacttccttatccatatgatgggacaatatctgtcttatcctctgcacaaggtttttaagagggtgaaatgaagcaacattgataagacaaacaaatcctttgagaaaaagcaaaacttcaagcttgttcccttgcttgacctttgtactttttacttcatctgcctaaaaccctttcttcccaaataaccacatcaagtgttgttcaaatgtctgtttctcagagaggtcttctgtgattacctcatataaaacaggccccatcccccctgttattctctgtcccttctcccatattttcctttatcacacctgtcccacctgacacattacctatgtatttgtttatttgactgttgctttgcattaaaaaatacacttatggcagcaggggttttttcttgttcgctgctgtgactgtggtgcctagaacgatgccttacgtgtaatacatgctaccaaacgtttgtagtgtgaatgaatgactataaatgctaagatactaagcagctttgttagtaccagcttgaataagtcacttaacctttcctgtgtactgtttcataaccttgcctatgtgctgttgcataacctattgcttctactcactctgtaatgttccatctactctccgtccttccgcagtcatttgccaggaatcacagatgcaccacagagattttgctcattgagaaccctaatttttgagatgctttcctgttatcatggccccagctatatcttccagaaaacataaacatatttgggaagtccaacctgtgatattcctaggagataagatattttgtttcttccctttgaaaaatcattcttccacaagtcccttttgtgtgcctttgtttttctaaattgtgcactggacttcacctcctatagatgaaaattttctctttcttcaaacagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294190 - DNA, 1079 bp, Homo sapiens
tggccatgaaggagtcctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 294191 - DNA, 1270 bp, Homo sapiens
cgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtaggctgcaaaggcattgatggaaacagacaaatga

SEQ ID NO: 294192 - DNA, 510 bp, Homo sapiens
ctacctcgctggctttgagcacaacccaggaagaagtttgaaaccaagaaaatggtggttgggaagaccaggatgcgcaatggcaagttgagggcaagcggggtacgtgtcctgaatttatagaatcttttgacacaaagcaagagagccacagtcaagactcaagtcaaaagaaatttagaccccatctgggcaaacaggcctctaagcaacaatctaagatttccacctattgttctggcattccttgtataaatgattatgactgcagagatcttaggaagtgctgtggtacctttagatgtggcctgaggtgcatacatcctcttatgattggccctgtatttttcaattcacctccacaatccaaggcataaatattggatggagaaatggattcagatggaggcatcattgagcttattcttgactcatctcagtccaaacattactctgtcaatcgttgttcttaaaatctgcatattaaaagctcagcatcaactatttttg

SEQ ID NO: 294193 - DNA, 220 bp, Homo sapiens
ctacctcgctggctttgagcacaacccaggaagaagtttgaaaccaagaaaatggtggttgggaagaccaggatgcgcaatggcaagatattggatggagaaatggattcagatggaggcatcattgagcttattcttgactcatctcagtccaaacattactctgtcaatcgttgttcttaaaatctgcatattaaaagctcagcatcaactatttttg

SEQ ID NO: 294194 - DNA, 454 bp, Homo sapiens
gctgaggtgacttcagtgggactgggagttggtgcctgcggccctccggagatctgaactggcccctcacgttttgctgataactgtttatcctgtgcctgggcagggaaaggacccatgggtgtggaggccaagcgctcggggatcctagagaccccttttcccgtcccccccagccgctccggtgcgctccgtagggcttcggggtcactgacttcgtatcgaggggccctcggctctcgccccttctgttttccccacctcctctagtacttctaacgcaaattgctctcgggcctgcacccagagccgagctctgagaaaataacttcaaggtcagccacccatgggtcctacgatttcgagagcgtatttagacatttagcttcggagagagagatcttcgtgtattttgcctttgcttcgaatgccttcagacactagctgctcccac

SEQ ID NO: 294195 - DNA, 897 bp, Homo sapiens
taaagacttccttgtctcctgcttttctgttacaaactcttacaagacaagataaatagaggctcagagtgaatgcttggggagggtattagggaagacattcttgcacaagaattacttggatcatatcactaggttaagtagaaaaatgaaaatgggtcctgaataagcatataatacgatccaaattgttacttacatgctttgaatgccttaaaaataatgtacagggcatttgtttggcagtgtgcttttatttatttccttacttattcctgtttcttttgcagaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294196 - DNA, 931 bp, Homo sapiens
taaagacttccttgtctcctgcttttctgttacaaactcttacaagacaagataaatagaggctcagagtgaatgcttggggagggtattagggaagacattcttgcacaagaattacttggatcatatcactaggttaagtagaaaaatgaaaatgggtcctgaataagcatataatacgatccaaattgttacttacatgctttgaatgccttaaaaataatgtacagggcatttgtttggcagtgtgcttttatttatttccttacttattcctgtttcttttgcagaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaaaaaaaaaaaaaaaaaaaatttgtgtgggcggccttgggcccttgggaaaagtttttaaaaccatttgtgtttgggggggggggccccagtgggttagggaaacggggccaaagggggccaggggagaacccgggaggaaaggggtgggggtttttctccaaaaaaaagggcgggggg

SEQ ID NO: 294197 - DNA, 625 bp, Homo sapiens
catcagtttgacataagattctactaaactagtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggaatgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtggggtgcagggaactggagggcaatggttcttatgagaaggtgatgatgcttctaagaaaaaagattacacgtaagttaatacctaacaattttttttaattctgaaattcaaatgttctgcattttgaaatagaatgaatattctctaactttttagtctaaaaaatttccaagctggagctaccactcatccttggaactgccaattcctaagcattttcatgctggcactgaatgttgcattgactagccattcctatgtgcagtttctaatgct

SEQ ID NO: 294198 - DNA, 1957 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294199 - DNA, 1991 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaaaaaaaaaaaaaaaaaaaatttgtgtgggcggccttgggcccttgggaaaagtttttaaaaccatttgtgtttgggggggggggccccagtgggttagggaaacggggccaaagggggccaggggagaacccgggaggaaaggggtgggggtttttctccaaaaaaaagggcgggggg

SEQ ID NO: 294200 - DNA, 1513 bp, Homo sapiens
gggcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294201 - DNA, 1945 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgatccttcttatggcaccaaacaaaccaaaaaaaatgtgggggccggcccaggaaattaaacatcggggcgcggccagagtagaaggcacacgggcaggaaccggagagggggtccaaaaccgggccgggcaaccacagcggctgccacgccgaacg

SEQ ID NO: 294202 - DNA, 2014 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctgtgagtcttggcttcagaactgtgcaaagaaccatgtgcctaaaaagccaacgaaagatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294203 - DNA, 1025 bp, Homo sapiens
catcagtttgacataagattctactaaactagtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggaatgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtggggtgcagggaactggagggcaatggttcttatgagaaggtgatgatgcttctaagaaaaaagattacacaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294204 - DNA, 666 bp, Homo sapiens
  misc_feature (47)..(47): n is a, c, g, or t
cgcccactcacctcctcccctctctgcccgcgccgtttgcaccacanattgcatatcacaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294205 - DNA, 1163 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaaaaaaaagggggcgctaagatcccggggggcagttagcgacacgttggtaaaggcaaaggggagtataaaggcggggggtaaggggggaggacggtggggaaccttgggggtggaacacaaacgaaaaagtgggagctgtggtagaaagt

SEQ ID NO: 294206 - DNA, 2581 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294207 - DNA, 708 bp, Homo sapiens
ccaccatcagcgctttattccgagtttcagtgctgtcctgggttaacctgaaagcaatctccgaggctcccctttctggctttcggggagccagagactgaccggacacttggctctgcaggtgcagacctggaccagagagacagagagccaaggaagtccacagtggagagagggctgtgctgggggttccaggaagacttcctggaggaggggatcttggagctaggccttgaagacgagtttgtcaaatgaggaagggcatccgaagccgagggaacggcagaagggaacgctggggaggggagagaatctggagagttccggaaaaagcaagtaggactctttccagaagttcgggcaagattttccctggatcagggcgtgggttctccagtactcgtccctcccggtcaccgagatgctctgagtttccggtctgaacctgaacgtaaagaggtgtagtccctcctttcttgaacgggaaaactgaacgcacataggtccttgccacgcctaaggctgcggagtgagcagatggaaaatgcgggactcaaaacctcccctcgctgtaatttgcactgccctgtgccaaactctgtcctttcttccattccttattcctattgtcagcctcgctgcgctaggaccctaaaaatttggtctcatgttgcccggggaacaacatttcgctacacctacctccat

SEQ ID NO: 294208 - DNA, 429 bp, Homo sapiens
  misc_feature (2)..(2): n is a, c, g, or t
  misc_feature (7)..(7): n is a, c, g, or t
  misc_feature (28)..(28): n is a, c, g, or t
  misc_feature (83)..(83): n is a, c, g, or t
  misc_feature (93)..(93): n is a, c, g, or t
  misc_feature (155)..(155): n is a, c, g, or t
anggccnatccccgcgaaatgctgctgnaagagcctcggaggggcgctgtgtggtaacatcaccccccccagggaggcccccnggcagagcanggtatgaccgtggcgctgtgtccatggtgaatttcccccaagaagcatttccatcctgtgantcccgtatgaaaggctttcctaagccctgaaatttgcagggtcatttccctcagtttgtgtattaaagaaaagctgccccagccaagcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294209 - DNA, 2518 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294210 - DNA, 2706 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaaaaagaaaaagaatcaaatacaaaaccaaaaaccgtttgttcggcgcgctttgggcccccggaaaaagtttttctacacacttccgttgggccgcgggggccccatatgggttactgtgtgacgtgggccaaaacggtgtccccagggaaaaccgggccaagaatagggctgggtttctcccaattaaa

SEQ ID NO: 294211 - DNA, 1930 bp, Homo sapiens
  misc_feature (1917)..(1917): n is a, c, g, or t
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctagaccttagggtcttagggagacaggttaacaccgaagaatacggacggnggatgttcagaca

SEQ ID NO: 294212 - DNA, 2736 bp, Homo sapiens
ccaccatcagcgctttattccgagtttcagtgctgtcctgggttaacctgaaagcaatctccgaggctcccctttctggctttcggggagccagagactgaccggacacttggctctgcaggtgcagacctggaccagagagacagagagccaaggaagtccacagtggagagagggctgtgctgggggttccaggaagacttcctggaggaggggatcttggagctaggccttgaagacgagtttgtcaaatgaggaagggcatccgaagccgagggaacggcagaagggaacgctggggaggggagagaatctggagagttccggaaaaagcaaattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294213 - DNA, 2502 bp, Homo sapiens
ttgtccccacccatgctttcttctggtccccgcctcggagcctcagtttccccatctgcaaactccggaccctggagacgctgtttggaatgtgagatgggcattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294214 - DNA, 1849 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtaatgtttcatgtttgtaggaaactccactagcatggtaatgatatctcccgtggtcataggggaagatattttttaatatgtgcatggccccc

SEQ ID NO: 294215 - DNA, 1163 bp, Homo sapiens
ggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagagagcagctgactcatgctggcatgtgatgttctgacggctctcctcagtggacttctggcacggcgtagcttgggagccaagtcagtgcgggcaggctctcgggtgacagtgaccggtcgagc

SEQ ID NO: 294216 - DNA, 1779 bp, Homo sapiens
ggtgtcactatgcccatgggcctccaatgtggggcctgtccccgtgtgaaacagttcgtcgatgcctggggtccattggttccccggggccggggtccatcctggtgagtgtgttgtagctccttgttgtccttgtgcggtattttcgtggtgcgttctgagctaggctgcctaggtctgcgagagggcctggggcccgtggagcaggagcgcagtgcggcagcgcccggggagagggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294217 - DNA, 1753 bp, Homo sapiens
gctcccttgtctccaccctctcctcttcttctgaccctcccccaggtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctaaaa

SEQ ID NO: 294218 - DNA, 979 bp, Homo sapiens
ccaccatcagcgctttattccgagtttcagtgctgtcctgggttaacctgaaagcaatctccgaggctcccctttctggctttcggggagccagagactgaccggacacttggctctgcaggtgcagacctggaccagagagacagagagccaaggaagtccacagtggagagagggctgtgctgggggttccaggaagacttcctggaggaggggatcttggagctaggccttgaagacgagtttgtcaaatgaggaagggcatccgaagccgagggaacggcagaagggaacgctggggaggggagagaatctggagagttccggaaaaagcaaattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagcaagtcccccatttgtccattctctccctcagagaccccatctgtgcaacccctgcatgagaccccctctcaatcccgcattcattcgctgctggaaatgctga

SEQ ID NO: 294219 - DNA, 4866 bp, Homo sapiens
ggaacatgggaagccttgttttaccattcacagtattttttaatttctaaaagctaaaacaaagaaaacaaagccaatatcccccattctttagggtattaatacatttatatgaagatgaaaggggatagttttttctttaacacagtaatgacgcagaagaatatacttctggtctctgtagcatataatggtaaaagatattagcatttaatgtgtgttacaagccttaggttagtattttggaaaggagagtaactgagtataaattgctatgcaaatttagaaaatttttggcaaattttatgactaatactaaagcctccaagaccttacaaatgtagttatcctttaacagtatattcattacgtactattaattaggcactatagtaggtgccaggcattatcatgggtataaaacacatagtctgccttcacagaacttactgtttagcagaggagacaaatattaaatgaataggtacctgtggttagtagcgataaatgctctgaaggaaaaaacatacagtactgtgagaatgtagtattttgaaatgtttcatttgcaaaattgtacttgatactcagaatagtgtttttttttcctaaaatacttaatatgctgaacaggtcaatgtatcatctgcctagtatgcataaacaataacagtaaatgtttagtaatttgagcacagttgggtatgttcatgtattttttattccttactctgtttgcattgccagtgtttgattttgctatttcaaagaaatggcattttgttgagtttgaaaatttgaaggtgcattggatcctgctaatttgttggattctgctaaattgtagcagtacagctctcaggttttgtagttaagagcataacttcactaaataaaaatatttttaatacaataatatggaatcagagtaactctcctttttcctgctcaaactttgatttgctgaagctgcttcccgaaaatcatgtgtgtcgactctctggtcagaatttgctccggactctcttatggcagaatcagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatatttaaactttcagtggt

SEQ ID NO: 294220 - DNA, 2076 bp, Homo sapiens
  misc_feature (1208)..(1208): n is a, c, g, or t
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagtttcgctcttgtttcccaggccggagtgcaatggcgccatctcggctcaccgcaacctctgcctcccaggttcaagcaattctcctgcctcagcctcccgaatagctgggattacaggcgcccaccacaatgcctggctacttttcatattttaatggagatggggttttaccatgttggccaggctggtctcgaactcctgacctcaggtgatccgcctgccttggcctcccgaagtgctggaattacaggcatgagccactgctcctggcctaagatgttttttaaataatgtttttaactaaattttaagaatgtttttaactaaagttatttatatttggaataattcgttaatgatttgtgtcatttccccaacccctttttaaatttgtgaatttgaggactggattaaaagataaaaagttgttggatcttatttattttaaagtcttctggtaattgagcaagttggttatatttctgggacaatgtaataaacatagttcatttcccaggaggtttttgttttgttttgttttgtttcgttttgtttgagacagagtctcactctgttgcccaggctggaatgcagtggcacgatctctgctcactgcaacctccgcctcccaggttcaagcgattctcctgcctcggcctcccgagtaggtgggactataggggcgtgccaccatgcccgggtaattttttatatttttagtagggacgggntttcaccgtgttagccaggatggtcttgatatcctgaccttgtgatctgcccgccttggcctcccagagtgctgggattacaggcgtgagccaccgtgcccagctgacttcacaagaactttaaacttgtgtcagaaagcacatggaatggagggaactaagaattgtttctttacataggttggctttataaatatacatattccataactaataaggaatgaaggagaaagaggtagccttattaaggataaattattctcgagattcataataacctactggaggacttggcctgacaatgtagtgaatagatttaacctgtggcctattgaaaagaggtgtttctgttctggactttttagggaccacacagaaagatttaactgaattcctttattatactaaaggtgcagattatgttcatgttcatctctgttgtcttgtatatgtatgtccttttctatcactactggcttttctgaattatttccagagaagtgaatgtctgtttcactttcatgtttttttcttcataagaactttaaaatactttttaagctaatgtctcaatttttaaatttatagctaacaaatatatttaatcttcagtgcgctagaccaatccatttaaatgaattgttgtttttttatactttcaaattcagttctgaagattttaagtatgggaagtatacttttctttacaagatccttttcttactgtgtatctaatcataggtataatttggtgaccatggttatgttttgcacattgatttccatttgtttcatgttagaaacagtactaaactgttctgtgaccataatttgtaaataaagtggtgttctgtttaaaaacaagccc

SEQ ID NO: 294221 - DNA, 961 bp, Homo sapiens
cccctcggattcgacggtttctctttcacctttaaaatttggtttcccagactctcctaggtttccctctaccacacctgctttttaatctttgtggaattctctcccttcctcactttgtatcccatccatcagtgaattttaatttccctttgtctcccagattcccctttatgatccacatctttccacatatccttctctttccaccaatcctaggcgtgtacatatatccaagtatgtttttgtttgtttgtgagactcctttcaaaaaaaaaaaagaaagaaagaaagaaaggaaaacagccagcatggcttatgggagtgaggagggaacagagaaatgggcaggggccagatcatagagagtttagtaaactaggattaggaatttggattttatctaaagtgttaatgataaacaggggaaacttaatctgatctttttgaatgatcactttgttggctgtgtagggaacgggacagaaatgaaagacggaaatccatgagaaagctatattttagtagattaggggagaggaaatgatgggtttgactaggatgatggttatttagatggaagaaggaaatggaatatgtcttggagataaaagggaatcttggagacaaaaggaaaataaaaatcactgatggattggatatgaagtgaggaaaggagagaaatccacaaagattaaaaagcaggtgtggtagagggaaaactaggagagtcttggaaaccaaaatttaaaagtgaaagagagactgttgaatgctgcagaggaggaggatgaaaccttagaattgacagtgaatttggttacatgaaggtaattggtaaccttgataataccattcttgggttgggatgttgtaaagagaaatttagaggtaaggaagcagtaacaaccattggcaatactttgacgaagttctgcattgaagaggagcaaaaaaaaaa

SEQ ID NO: 294222 - DNA, 3845 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294223 - DNA, 3685 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294224 - DNA, 3743 bp, Homo sapiens
gctgcggcggtatagaggatcccttatttctgttacaggatagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294225 - DNA, 3392 bp, Homo sapiens
atctagctcttgtttactgattttagcataaatttttggtacgctaaaattgagcttgtatgaaaaaaaataatatgacctatgtgcatatagtaggccatcaataaataacataaatagcattcaagatcaatttgttaaatggaattaactggtcttgatctgtcttcttcttttctagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294226 - DNA, 3791 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294227 - DNA, 4757 bp, Homo sapiens
  misc_feature (2680)..(2680): n is a, c, g, or t
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggtaggttttctgtgcaatttgtgatttcatttttatgtatatgtatctaataaaaaaaggaacaattgcttggttttgaaatgagaaagttttttcagaacttttatccagaacttactttttaaataataacacattgcaaaggagtgctatatattttacaatatttatatgcaaacattctactcttttaccaaagccaaaccaaagaaatggattacactgtaaaacaaaacaaaacaagacaaaaaaaacctacaagtgtgaaatggatttttaactcttttattttccatgaggttgcctcttatttctccagtgttgaaaatactggcattcttcatactggaactcctaagaatgcattattgttgtgaaattggtgcttcaagactaccaaaagaggactgggtgtggtggctcatgcctgtaatcttagcactttggagcctgaggcaggtggattccctgagctcgggatttcaagaccagcctcggcaacatgncgaaatcccatctctactaaaaatacaaaaaattagccaagtgtggtggcacatgcctgtaatcccagctactcagaaggctgaggcatgagaatcacttgaacctgggagatggaggttgcagtgagccgattatgtgtttacttttatttcagatttttaatataaatgtgggtgcgtacatctttttatgcagctaagtctttaataactagacactatcccattaaaatagtaccatggtcttataaaacttgaattaggcacataaaattttaatgcagaaatgggtaagcagttagatacaaaatatttaggtttactactcttatttgctagccatttgtgtatacttgaggcccacttttctgtacccaggtaatttaatatgtgtgcagcagttatataatagaagggtgagtaacttttcattgcttgctaggcaccagctgtaagctccttgtggatgggtgctcttgtcagtcaaccagcacctctgacagtgtctagaatatgtctagtaagcactaaaaaagtacagtagtttttgaatggcaatctggttagtgcacgctgtttttaggatactcccacctcccggaatcaggttgcttctagacatcttttccttccctagtgtacttgggtctggactgggagagactcattgacttttctcctgagtcactttgaggctgggtcaggtttatagccattctatagatttaggtctattcatttgcttattcaacaaacaatgagaatctgttatataacaggcactgatttaggtattggaaatacagtggtgaaccagacagagccttgtttctcatggaattcgtaatctactgggcaagattggcaatagtcaaacaaagcaaaaaataccagctaataatatgtattattaaaatgaggggacttagtaaagataggtttcagaaaagacttatctaatgaagtatgagtactaatctgaatgacaaggagcagccctttaagatcagggcagagagaatttcaagaacaacgaacatttggtaaaatacctgaggtgaaaacaagcttgacatgattgaaggacagaaaaaagccagcattaggccaggtgtggtggctcacgcctggaatccctgcattttgggaggccgaggtgggcagatcacgaggtcaggagttcaagaccagcctgaccaacatagtgaaaccccgtctctactaaaaatacaaaaacttagccaggcatggtggtgggcgcctgtaatcccagctacttggaaggctgaggcaggagaattgcttgaacccaggaggtggaggttgcagtgagcttagattgcaccattgcactccagcatgggcgacagtgtgagactcctttcaaaaaaaaaaaagaaagaaagaaagaaaggaaaacagccagcatggcttatgggagtgaggagggaacagagaaatgggcaggggccagatcatagagagtttagtaaactaggattaggaatttggattttatctaaagtgttaatgataaacaggggaaacttaatctgatctttttgaatgatcactttgttggctgtgtagggaacgggacagaaatgaaagacggaaatccatgagaaagctatattttagtagattaggggagaggaaatgatgggtttgactaggatgatggttatttagatggaagaaggaaatggaatatgtcttggagataaaagggaatcttggagacaaaaggaaaataaaaatcactgatggattggatatgaagtgaggaaaggagagaaatccacaaagattaaaaagcaggtgtggtagagggaaaactaggagagtcttggaaaccaaaatttaaaagtgaaagagagactgttgaatgctgcagaggaggaggatgaaaccttagaattgacagtgaatttggttacatgaaggtaattggtaaccttgataataccattcttgggttgggatgttgtaaagagaaatttagaggtaaggaagcagtaacaaccattggcaatactttgacgaagttctgcattgaagaggagcaaaaaaaaaa

SEQ ID NO: 294228 - DNA, 1622 bp, Homo sapiens
ggactagtcgacggggattgaatctgtgaatatgcttattctagtggtgcgtagagaaaatattgtaggagatgcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 294229 - DNA, 2867 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagtccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataaggtaaaatgtccaaccatctaaattacttctgtgtatatacccatgtatttatacctgtatgtatcaagttaattcagtaaataaggaattactactggatccctaacatataagatctgctttattacaatttgagaaattataaactttggacttggagttgtcaaaatacatttgatgcttaccacacattttaaattaacaaaataaataaggcaggcgtgccgaccgcgatatctccttatagaaatggataatggtctctgatataatgagtggagc

SEQ ID NO: 294230 - DNA, 1252 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatggtaggttctcattatgtatagtttaagtgtactttttgaaagagatggtcttttgagttagatcagtgattcttagtgtaagagagaaatgtatcttccctggtatagaggtggggatgagatgttatttaaaaattccatttggggaatgcagtgggaagatacaaaatatcctttattcattaaagaactataaaaagtatatctggacaaaatgtttagtattggatgtttattaaaagacaattgaaaaacattacttcaaattgttaatccattattggccactgttagtggaaaaaagctgtaaaattattct

SEQ ID NO: 294231 - DNA, 272 bp, Homo sapiens
gaagtccttaggaaaacaaagaacatagattacaagaagccactcaaggtaatttgacattttctgtggtataattgggacttttattcagaagctatgtttaaaattttcctatttgtttttagtgaatcttttaaacttaataaataaaattatatttattttaaactattaattgtagagtattagtaataaataacatgttctagggtctccagaatgtactttcatttctttacagtctatttggtgtttgcattgtgctattttag

SEQ ID NO: 294232 - DNA, 254 bp, Homo sapiens
caatggtcattggaaatacaaattatgattggaaggaactggaaaaggtaggggaaaactaatctctgatattgttaaatggaaagatttatatatggaaatcttgcctttttatgtattattttttattttatacactttattactaccattttacaggaaagcactctacccttcaaactccacaatgaatggatttgaacggtatatgaattagacactattataattggtggtattgatatagaaaactc

SEQ ID NO: 294233 - DNA, 568 bp, Homo sapiens
aaatattaaaagtttgtcagatatccagattgtacaggttgcttgtggttactatcattcacttgcactttctaaaggtaagcattagtttttattttatttctcttcagttttattacttgatacttttttgattgtgcatatagttctccagctttgctcatctttctgcaagattgccctggttcttgatccttttcatttccatataacttttagaattagcttgtcagtctgtacacacacatacacacacaaacacacacacacactgctaggaatttgggattttgttgtctctataaatcaattcaaggaaaatctttacagtattgaacctttcaattctagaacacggtatatttgtccatttaagtctccctttaattttttccattagcattttgttttccctggacaggtcttatacaccttcgattagactttcccctaggtatttgattttttgttgttgtgaatggtgtcattttttgtttattatatagacatgaaattgatttttgtgtctgtttattaaacagttaaaaactcttcatagctgcaactg

SEQ ID NO: 294234 - DNA, 482 bp, Homo sapiens
ttttatttttatttttttttttgagacagagtttcgctcttgtttcccaggccggagtgcaatggcgccatctcggctcaccgcaacctctgcctcccaggttcaagcaattctcctgcctcagcctcccgaatagctgggattacaggcgcccaccacaatgcctggctacttttcatattttaatggagatggggttttaccatgttggccaggctggtctcgaactcctgacctcaggtgatccgcctgccttggcctcccgaagtgctggaattacaggcatgagccactgctcctggcctaagatgttttttaaataatgtttttaactaaattttaagaatgtttttaactaaagttatttatatttggaataattcgttaatgatttgtgtcatttccccaacccctttttaaatttgtgaatttgaggactggattaaaagataaaaagttgttggatcttatttattttaaag

SEQ ID NO: 294235 - DNA, 434 bp, Homo sapiens
aactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacc

SEQ ID NO: 294236 - DNA, 2437 bp, Homo sapiens
gggagggtttttttttttaattgtttctttgatgtttctggacagtaaatatttgaaattttcctaggatcagtaatgaaggtacacaaagtactttgggtagctataaagaagactgctgcatgtgatatgtatattcttatgagaacatttataaaaaaaggttgcagtgaaaatggaataacttaacctataatcattttatatattaaaaattgtataagcctctttcattacagaaatattcaatctttataaaccgttttactagtttacttgataagatgttggtttgtttcaaaatcttgtttcattatatgtcccctttttatatgcttggtaagagatggaagtcactagaggtgagagatgttaaaagtaggaagcatttgatctcgttaggaagaagatgtgaaatttccttgaagaaagtttcaataataaggtattaaacatgttcctggggttggtcaccattatctcctattcctctttcttttccccttcctatcaccctttcccatccattttatgttgagagttctttcatttatagagaggattttttaaactaattcatattatgactttaaagggttacagtaagtttgctttatcatttgatcctgtaaataaaaaagattttgagctgcttcctctggtatagaatatctgactataccaactaaggattaaggaaaggatgaaaagaaagcttgaatatttaatagtctaaaaatattttaaaaaattaaaaaccttcaaatcttggtaaccatttttattctgttcaaataaatgcatttggtattctaaatatttttgtagtgttctatactaacagctagtaagccaattttttgggggtctttgttaaaacgataagttaataacttggtgattttaccatgggatattccattttagaacaagaactcagggagaaccataataaaagaacaaaagttttaaatggtaaaagtcaaatccttggtccgtgagcacataccatgatcacttagttaagtgaatttgtgtaatgcttccttagccagatcattccttattctttgttttttattttttatttttgagacggagtttcgctcttgtcgcccaggctgtagtgcagtggtacagtctcagctcactggagcctctgccttccaggttcaagtgattctcctgcctcagcctcctgagtagctgggattacaggcacacaccaccacgccctgctaattttgcatttttagtagagacaggatttcaccatgttggccaggctggtcttgaactcctgacctcaagtaatctgccctcattggcctcccgaagtgctggaattacaggcgtgagccactgcgcccagcctgttccttatactctttaaaggtttgtttttgctcctccctctttaccctcccctccagtgaatgttttttagaaaaaccaatgctcagatttatcagtattactaccgttctgtactggcttactctaatggtgttatgagttatacattatacattagtataaaaacattcaaaagggtactctttatgctcagtttattaagttttatgctgtgcgggatactgttaggtgctatgttaattcagtagcataggaattatagaatacctgtaactaataggtagaggttagcttgtttcagtcacagtagctttattgtagcattgctgttaaaatgttaatcttttgttttccagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataaggtaaaatgtccaaccatctaaattacttctgtgtatatacccatgtatttatacctgtatgtatcaagttaattcagtaaataaggaattactactggatccctaacatataagatctgctttattacaatttgagaaattataaactttggacttggagttgtcaaaatacatttgatgcttaccacacattttaaattaacaaaataaattaagagatggttagccagaaaataatgttgactattccttctgctgatttcaatttgaggattgaataataatcaccagattaacttttctgttgggaaaaattaatttatcattagggatcattgatttatctaccttgtcatttagagcaggtcagcggactatagcccattaatctc

SEQ ID NO: 294237 - DNA, 1199 bp, Homo sapiens
catcactctgcagacaattggcagccaggagacgggcagctgccgcaatcttcagatttctctctatttaaagttcaaagagacgctggataacaaaagaaagaggtaagcgtggcctgacctagccacccaccaacaggaataatggctgaaaaagcggggtctacattttcacaccttctggttcctattcttctcctgattggctggattgtgggctgcatcataatgatttatgttgtcttctcttagaaaggcaagaagatatcagattgacatcatttagaagaattaagaaaactatgaacatgactgattattaaatgtctcatgttaaacaatgcaatgtttgacatcactttacaaacttggatcataaactggcactttggtatgcataagaatttcttcaggacaataagaaattatgagtgaatttctctatattctgagtgagaaaaatgtttagctgtgatgaaaaatgcatgtcattaaaaaaagtttgataaatttaatcacattacaaaaaattatccccccttccctctggaaaaaactatagagaaagtgggctgaggctgtgcaaggtggctcatgcctgtaatcccagcactttgtgaggatcctttgagcccagaaattggagaccttcctaggcgacagagagagaccccatctctacaaaaaaaaaaaaaaaaaaaaaaaaaaagaaagaaaatgggctagagataaaaacagacaattcagagaacatataatgtaaaagtacacttacttaatctcttgttcacaaaaagagaaatgtaattaaaactacactgaggaattgttgctcacttatcagatgggaaaaaaataaagatgtttgacaacatatgagttggtaagactgtgtgcaattaggcattctcatacattgtctttgggaattcaaaatggtacattttgcgggatgtttggcagtacatatctatcaaaattacatatatatttaatttttgacttagctatccctcttctaggaatatggcaatttccacaggtacatgagcaaaaatacaaaatggctcatatacaaggctatttattctggcataatttgtttagcaaaaacctggaaataagccaaatatctattaataggggattaactgaataaactgtggtatgtctacataatgtagtacttacgcagttgt

SEQ ID NO: 294238 - DNA, 871 bp, Homo sapiens
catcactctgcagacaattggcagccaggagacgggcagctgccgcaatcttcagatttctctctatttaaagttcaaagagacgctggataacaaaagaaagaggtaagcgtggcctgacctagccacccaccaacaggaataatggctgaaaaagcggggtctacattttcacaccttctggttcctattcttctcctgattggctggattgtgggctgcatcataatgatttatgttgtcttctcttagaaaggcaagaagatatcagattgacatcatttagaagaattaagaaaactatgaacatgactgattattaaatgtctcatgttaaacaatgcaatgtttgacatcactttacaaacttggatcataaactggcactttggtatgcataagaatttcttcaggacaataagaaattatgagtgaatttctctatattctgagtgagaaaaatgtttagctgtgatgaaaaatgcatgtcattaaaaaaagtttgataaatttaatcacattacaaaaaattatccccccttccctctggaaaaaactatagagaaagtgggctgaggctgtgcaaggtggctcatgcctgtaatcccagcactttgtgaggatcctttgagcccagaaattggagaccttcctaggcgacagagagagaccccatctctacaaaaaaaaaaaaaaaaaaaaaaaaaaagaaagaaaatgggctagagataaaaacagacaattcagagaacatataatgtaaaagtacacttacttaatctcttgttcacaaaaagagaaatgtaattaaaactacactgaggaattgttgctcacttatcagatgggaaaaaaataaagatgtttgaca

SEQ ID NO: 294239 - DNA, 1181 bp, Homo sapiens
agaggagattgctgataccagactcgaagaacatgagcactatgatgtgaagatgtgtctgcttccccttcaccttccatcatgattgtaagtttcctgaggcctactcagctatgattccaatacagcctgcagaactcggggtctacattttcacaccttctggttcctattcttctcctgattggctggattgtgggctgcatcataatgatttatgttgtcttctcttagaaaggcaagaagatatcagattgacatcatttagaagaattaagaaaactatgaacatgactgattattaaatgtctcatgttaaacaatgcaatgtttgacatcactttacaaacttggatcataaactggcactttggtatgcataagaatttcttcaggacaataagaaattatgagtgaatttctctatattctgagtgagaaaaatgtttagctgtgatgaaaaatgcatgtcattaaaaaaagtttgataaatttaatcacattacaaaaaattatccccccttccctctggaaaaaactatagagaaagtgggctgaggctgtgcaaggtggctcatgcctgtaatcccagcactttgtgaggatcctttgagcccagaaattggagaccttcctaggcgacagagagagaccccatctctacaaaaaaaaaaaaaaaaaaaaaaaaaaagaaagaaaatgggctagagataaaaacagacaattcagagaacatataatgtaaaagtacacttacttaatctcttgttcacaaaaagagaaatgtaattaaaactacactgaggaattgttgctcacttatcagatgggaaaaaaataaagatgtttgacaacatatgagttggtaagactgtgtgcaattaggcattctcatacattgtctttgggaattcaaaatggtacattttgcgggatgtttggcagtacatatctatcaaaattacatatatatttaatttttgacttagctatccctcttctaggaatatggcaatttccacaggtacatgagcaaaaatacaaaatggctcatatacaaggctatttattctggcataatttgtttagcaaaaacctggaaataagccaaatatctattaataggggattaactgaataaactgtggtatgtctacataatgtagtacttacgcagttgt

SEQ ID NO: 294240 - DNA, 879 bp, Homo sapiens
agttaaatttgaatgttagatggagggaacttcctttccacaatgacatgattttgtaaagctgagtgtatggcagttgtcatgattaaaagcaagtgccatgcagaagttattgtgtaacaggaaatgagattagatagcgtccaatctaatctcaaggtttgagtagctgtggacagcccaacaggcacaggcctcccgttagtacatccatacgagaagttaagaatgagtgaaaatagtttttttttttttaatttatgtgcattatttttttcaagcagctaccttgttaggacatacttaatagttatcttggcctacctactgcacttactaaacaactgttcactttttaatttttaattttcagatttttttgagacggattgttactctatcgcccaggctggagtgcagtggcgtgatctctgctcactgcaacctccgcctcccgggttcaagctattctcctgcctcagcctcctgagtatctgggactacaggtgtgcgccaccacatccagctaatttttgtatttttagtagagatggggttttaccatgttggccaggctgatctggaactcctgacctcaggtgatccacctgcctcggtctcccaaagcgctgggattacaggcatgagccactgcgcccagccactgttcgctttttttctcagtggttctctagtccattgccttaaccactcaccatgactacagctcttatttgcagtgactctcaagaatgcaaatgcaaatgccattcctgacctcgagttaattcagctttgtcccctgagcatgggggaaaggcaggctgggggctggaactttctgcttgtgtacctatctctttagactctggaggctcc

SEQ ID NO: 294241 - DNA, 897 bp, Homo sapiens
agttaaatttgaatgttagatggagggaacttcctttccacaatgacatgattttgtaaagctgagtgtatggcagttgtcatgattaaaagcaagtgccatgcagaagttattgtgtaacaggaaatgagattagatagcgtccaatctaatctcaaggtttgagtagctgtggacagcccaacaggcacaggcctcccgttagtacatccatacgagaagttaagaatgagtgaaaatagtttttttttttttaatttatgtgcattatttttttcaagcagctaccttgttaggacatacttaatagttatcttggcctacctactgcacttactaaacaactgttcactttttaatttttaattttcagatttttttgagacggattgttactctatcgcccaggctctgtctcaaaaataaaaataaaacataaatgcactggaggaaagagggtaccactctccttaaggcgggggctgccaacttgtcctgcacagcccgtccgcctgcctcaggtggacttaaagcccagctctgagggactctgagcagtcatttaacctctctgagcctctctttcctcccctgcagaagggggattataacagttcctaattcatgagttgttcttggagtgaaatacattactggccaggtgagatggctcatgcctgtaatcccaacactttgggaggctgaggtgagaggattgcttgagcccaggagttcgagaccagcctgggcaacaaagcaagacccccatctctaagaaaagtaaataaataggcagggtgcagtggctcacccctgcaatcccagcaccttgggaggacgaggtgggcagatggcctgggctcaggagtttgagaccagcctgggcaatgtggcaaa

SEQ ID NO: 294242 - DNA, 753 bp, Homo sapiens
cgcggtggctcacgcctgtaatcccagcactttgggaggccgaggcgggcggatcacgaggtcaggagatcgagaccatcctggctaacacggtgaaaccccgtctctactaaaaatgcaaaaaattagctgggcgtggtggcgggcgcctgtagtcccagctactcaggaggctaaggtaggaggattgctcgaacccaggaggcagaggttacagtgagctgagatcgcaccactgtactccagcctgggtgacaaagtgaggctctgtctcaaaaataaaaataaaacataaatgcactggaggaaagagggtaccactctccttaaggcgggggctgccaacttgtcctgcacagcccgtccgcctgcctcaggtggacttaaagcccagctctgagggactctgagcagtcatttaacctctctgagcctctctttcctcccctgcagaagggggattataacagttcctaattcatgagttgttcttggagtgaaatacattactggccaggtgagatggctcatgcctgtaatcccaacactttgggaggctgaggtgagaggattgcttgagcccaggagttcgagaccagcctgggcaacaaagcaagacccccatctctaagaaaagtaaataaataggcagggtgcagtggctcacccctgcaatcccagcaccttgggaggacgaggtgggcagatggcctgggctcaggagtttgagaccagcctgggcaatgtggcaaa

SEQ ID NO: 294243 - DNA, 2500 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattat

SEQ ID NO: 294244 - DNA, 2253 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaacgcaacagctaggatttttaactttattagtaaaatcttgaagttttcatgatctttaagggtcagaatcttttatgatgattcatagtatgcttagaataaggtgc

SEQ ID NO: 294245 - DNA, 677 bp, Homo sapiens
tttacccctatctccgcacgcgccgcagaaaacaatcgttccaggcgtacagcgttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattat

SEQ ID NO: 294246 - DNA, 504 bp, Homo sapiens
  misc_feature (18)..(18): n is a, c, g, or t
  misc_feature (24)..(24): n is a, c, g, or t
  misc_feature (29)..(30): n is a, c, g, or t
  misc_feature (51)..(51): n is a, c, g, or t
  misc_feature (54)..(55): n is a, c, g, or t
tctggccgcccgcgccangatatnaacannataaaaaattataaaaacttnagnntaacgttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagaca

SEQ ID NO: 294247 - DNA, 782 bp, Homo sapiens
atgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaaatttattgagcgtccactgcatgccaggcactttaccaagcattgagaatagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaaagtcttcaatgcaaaaaagtcggtgcttcgtttcaaccgtaagtgactttctgtatgttgtgcagattaaactaaaaaatgttggccggggcgcggtggctgacacctataattccagcagttccggagaccgagacgggcagatcacgaggtcagaagatcgcgaccatcctggctaacatggtgaaaccccgtctctactaaagat

SEQ ID NO: 294248 - DNA, 3682 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294249 - DNA, 2783 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaaaatgggcttcgttggctcagagggggagctcttggggcgcttccctctagcgaggggtattcaagaagccttcatacttacttcagtgggtcagatcggtgcgctgcgcgaagcgggattacgctactccaagcggggcagtccgcttccccagaatgggcggaccgcaagacgacctggctcgcaagcccctaaggccgcactgtaaaggcgcgtcgtggcttttctaaggtccccca

SEQ ID NO: 294250 - DNA, 3717 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaaagtcttcaatgcaaaaaagtcggtgcttcgtttcagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294251 - DNA, 3265 bp, Homo sapiens
cgccctttctttttcctgatgagaaatctgcagtcattcaagttgatatatgtttgtaatacatcagttttctctggatgttttaatggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294252 - DNA, 3508 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294253 - DNA, 1993 bp, Homo sapiens
  misc_feature (19)..(19): n is a, c, g, or t
ttggcacaacgtgtgtggncaaagaatccccgttatttatggaattcccagagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294254 - DNA, 1865 bp, Homo sapiens
acgacacacccgaactattaaattaatttttttttgtaattagttatactcacagtgttgttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294255 - DNA, 1857 bp, Homo sapiens
tttttctctattgttcctgcaccggagagaaaacgacttccaggttcacacgttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294256 - DNA, 1865 bp, Homo sapiens
  misc_feature (18)..(18): n is a, c, g, or t
  misc_feature (24)..(24): n is a, c, g, or t
  misc_feature (29)..(30): n is a, c, g, or t
  misc_feature (51)..(51): n is a, c, g, or t
  misc_feature (54)..(55): n is a, c, g, or t
tctggccgcccgcgccangatatnaacannataaaaaattataaaaacttnagnntaacgttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294257 - DNA, 1857 bp, Homo sapiens
  misc_feature (27)..(27): n is a, c, g, or t
  misc_feature (36)..(38): n is a, c, g, or t
tatctccccccctactaccttacgaanacaaacaannngttagggtgacaagttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttcaaaaaaaaaaaagctagaaatgaatctaggcgtaggtgaacttttgctaagcagaaataacactactttgttgcctagagaaagataacttctcaagtatttttattccagtcctagatcatatatgttcttttgtgcaacggaattctaacagttctaagagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatgactaataccattctatgagaaagagtagttatatgcccagactgtattaatttactttagaaactaatgtttgaagtaatggaaaaaattttaaattataaagctaaggtgcaataacatttgctacttatttatagaattatttgaagaattttgtttttgaagtaatgctttaaggagtataagatattcaagataaattatactataaaatgattttattgaaagttgaaggttacacaaattgttttaggtatgagcagaagaggttaaggtatttctaaaggtaacatatagtcaagagtttcctcaaaatagttatttggagaagaatcagaatgtctgtgtatttcttgtctgtttctatgttgtcttatagctctgactaaatgtgtttacctatgcaaaagatttattaaagcatagaaaaggtgaatgaataaaaatataaaataattgtcctttttcttaaaa

SEQ ID NO: 294258 - DNA, 2794 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattataaaaaataaaaataatggcctcgttggcctcaccgggtgagctctggggccgcctccttttatggagggttaattaatgaacctccttccttgcccgctgcctcggaggtaggttggggaagcggtatacctactcaaggcggcatacggtttcccagatcagggaaatcgagaaacaactgtgtgcaagtggcttataggcctaaacttaaacgccgtgtgtgtggtattctgggctcgccccttgaagcctaaatactctcctcatgcacgggggaacctcacggctttata

SEQ ID NO: 294259 - DNA, 2321 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagaca

SEQ ID NO: 294260 - DNA, 1798 bp, Homo sapiens
ccacccagtgcactgcgtttaggcatgcccacatggagagaggcgaccacagcggtgatcataagcccatggtgggcagaggccctatggagccaagggctccggccgccacccccgctccgccaccagcagcgctgccaggactcgctcttcctcctcctcctcacacgccggctcggatgatctcctgccatgactcagcgcttctcgcaggctgccctgctggggacaccggcttcgctcgggcccctcccgacgcgtccaccccctctcgccacccacgcccgcccccagccgctgggcctttcccagtgcggccgccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatcctgcctcaatccatacagccacaacaccaagagcaactcccagatacaccgttcgcaga

SEQ ID NO: 294261 - DNA, 817 bp, Homo sapiens
aaagagcgatggagactgcggcccaagttaggattaggacagcggtttttcagtccggagattccggccacaactatttttgtctgtttttatcgtaagccagagtctttgggtgcagctctgggacacctaaagggcctggagaaattcaggcggggccagtgctgtgggggtagatgttagacgtggaagggaccctagagagccttgactgtgaggactgagacagggcctcctttgttgcccaggccggagtgcagtggctattcacaggtcgataatgcaatcatggtgcacactacagccttgaacttctgggctcatgtgatccttctgcctcagcctcccagcgctatcctcatcatacatatactgtgaagataaaatatctgttgaagattctttgagcaccttgggccagaagagctacagaaagccaaggtgtggctgtgatgacactgaattcagctcaagacccaggagaaccttacatctattcttatttccacaaggaagtgcacacatggctaatgcaaattcttccataataatgatataaacttgagttgtccaggtttgatgagacccacatcttgtatatacagtgtcatctactgcctctgttaggggctctaggggataaaggaaactatattaagaaatgcagcatctgtttctccctgtgtgaccaccctacttccaagaagtttctgtatccttggctgaagtgcactgtgtgtatgtgtatgtgtgtacactcttctacatcaatctgtaagtcactgaaatgctgcagatgttttaaaaaaattccacc

SEQ ID NO: 294262 - DNA, 624 bp, Homo sapiens
aaagagcgatggagactgcggcccaagttaggattaggacagcggtttttcagtccggagattccggccacaactatttttgtctgtttttatcgtaagccagagtctttgggtgcagctctgggacacctaaagggcctggagaaattcaggcggggccagtgctgtgggggtagatgttagacgtggaagggaccctagagagccttgactgtgaggactgagacagggcctcctttgttgcccaggccggagtgcagtggctattcacaggtcgataatgcaatcatggtgcacactacagccttgaacttctgggctcatgtgatccttctgcctcagcctcccagaaataagaagaaaaaaaaggatattaccaacaatggaagaggaatgcagagtggcaacagctccaagtggacctggcagactatgaacactagaatcaccaaggaaacatggagctatgaaatggcaaaaggctgtgtgaaaaccctgacgctttttggttcagcctttaaaaaccaaatgaaaactcaagagatacaagagtgtggttattttgatgaacaactcacaaactagttgaattaaaagaaactggttcaaatgaacacaaaccta

SEQ ID NO: 294263 - DNA, 2939 bp, Homo sapiens
ccgtgaagatgcatcatggtggactgtggtctcttctctgtggaatcctcgggagagtcccatgatcctaggagagggtgagagggcagatgtaagccagcattaagaagcctcaagcagagccgcaggaataatccgtgaattccctaacaatcctaaaggatctgcaggatgcttcaggcctgcctagatgttgtagggatcatgaatccgctgtaaattgagaggctggctgagacctgccaggtccaaataacctccccctgaggaaaaaaaaaagccactcttctagaaagaagaggagcacatcaaacccaggaacagaaatatttcactgctttattctccagtgtacatcccatggagaaacactagcagtccagtcctcagggccccttgaatttacttcatattcagttcctagctgagcaggaccttcacgtcactccttcattgtcttggaatttcattttgggacagatactttgagcagccataacatcagataaaggattgtcccatgagcctaggagagggcagatgtaagccagcctgtagtagcatcaagaagaggcccaggaataaaccacaatatttctcaggatccagaaacatctgcaacatttttcagatgtgtctagacattgtagagaaagaagaggaacacaccacagcaaaaataagacatcttccagtgttttgttgtcctgtggtgaacccagggagaaaatatagcagtactgtctgcaaagccgcttgactttacctcgtatatgggtcacagctgagcacgtgtttcatgtcgtgagtgggcactccaacatcgccttgagatttcatcctggaacatagagggtgagcagcaataagttcagcctagggttttctgggtctgaatccacgtcttccaaactaaaactttctgagttcacagaggaagaccctcatggaaatccactgcggaatccacagtgcccctcaactgcactactgttcaccagtttcaggcttgccatcaccacagagggcatctgagatattgtctgaacctcatctgcacccatgagagaccagatcgaggcagactgatagctctgacagctaggtgcctgtacctgcctcaggaatgcatatgcactagtctcaggacaccagtcctcattgtgagctctggctagcatcacaatgaatgtcatcattgcctagagacaagttcctgcctcttgaggaaggagacctccctgtaggtatgtcggctgtggactcttgcctgtcttctctgtgggatccaagagatagtcccatgatcctacgagagagtagatgtgagccagccaaaagaaacatcaaacagaggcccaggaataaattgcaaaatccctaaggatccaaaagatctgcaggattcctcaggcctgcctagatgttgtaggggttctacatgtcatgaagggcaactcctccatcatttcaggattttttttctggaacagagagtgtgaacagcaataaggacagatacaggctggctgacagttctgacagcccgtcgcccaagtctgcatactcttaggcacaaggactgagctatgggctcgggttagcatcacaacgaaggccaccattgcctaggcataagtctctgcggctttgcggagaagaactctgtggaggttagtcagtggtggactctcgcctcatttctctgtgggattcccgtgatagtcccatgaggctaggagagggaggaggtgagccagcctgaagaaaagtcaagcacagccccaggaataagccgcaaaactcctacagatccaaaaggacctggaggatgcctaaggcctcccggactttgtcaggcctagagtttccttggtctggctcaatgtcttccaaactcaaccattcccagttcatggaaaatgaccctcatgggattcccttgtaaaagctgcatgattgctggaggatggtttattgtcctacagccaacccaaaaacggcactaccagtcatgttgcagggccccttgaattaacctcgaattaggtttccagatgagcaggtgcttcatgttgtgaaggggccctcctccatcatcctagaatttcattctgggacacagagtgtgagcagcaataagagttgcactccgttgcctgggctggagtgcagcgtcatgatctccagtcactgcaagctctgcctcccgggttcatgccattctcctgcctcagcctcctgagtagctgggactacaggctgggtccactttgcccctcaacagcattactggacacctttgtcagactagcaatttccacagacaccctctgtgaacatttttcaacatcatctgcagcagtgagaggccagtttgatgtgtaagaatactgcttgactttggacttgcctttgtcatggttcctgcctttctcatagatctcctgccaggacaaggatgataggaggcaaggaagtcaagggcccagccccattcactgaaagctgcctctgggatctcaggtatgattccatcacataaaatcccctcaacaactcaccagactatattccaatctccgtgggacctgattcttgcacacagcctctttcacgaatggagccagaagagcagttttcagtgaccatctcagtttggaaaagcctcctccttcagtgggtctcagccacagagtcatcccgaaggggctctaaggtcaataattttagggtctgacagttgattatcacagacagactttttcatgatagcagatcatctctgtctatatcattttcctctgcttaggcaggctgacagctctgacagccaggcacttgaatctacctggcaaatgttcatgctctagtctcagtgcaaaaggcctgtttgggagttctggctagtgtcacaataaatgccgccattgcctagt

SEQ ID NO: 294264 - DNA, 1904 bp, Homo sapiens
atttttttttatagttcattaattagtctttattatgtgaaaagacttttctaaaattcttccataataattgaagatataaattacaataattaaaatttacaaaagaataaaagcattaaaataaagtgtgaaaaatttaaaaagggtaaagatgaaaattatttaatttttaatctcaaaaatccgaaagtgattttatcaatgtcctaagaaaattaaaatgaaaacaaacttaataatgtaaagaaaggaggtttctgccgggctgggggcgggagctacggcttctctggggacgcggaagcgagaagcagggaccttggggcgcgcccggttttccgggacggtgccccggcccccagcccacgcctccggccgctggcatggtgctgctggctgggacccggccgcagggtggctgggagcgctgcatgaccccgccaccgccgtccccactcctaggcgcacaggtcgaggaggaccgcgctgactacaaagagttccagggccccacacctgcagcatagcctgggacgactctgtaccctttccaggacgaggaggagcacggcgtcgagggcttggagagcgtcccggaggagggcgtccaggaggcatggggctgctgcggacgctggtgcggcgaggggtgagcgttgagaaggcgcaggagactgaccacaatggctggaccagccttaatgtcgcctgctaccacggctttgtggatataccgtggtggccttagctgagtaaccccacactgacgtcaactggcaggacagggaggggaacgcagccctaaatacagctgcacaggcaggagctgcctctggccccatgggcaccgttgccttggacactggctctcagccttgtgcttcctggtcagcatcacgtgggctggttcatttgagctttaacacagatctggtggaaacacaggctgccaggccctgcccctggagtctttctttgaataggcctggggtggggcccaagaatgagcagaagaacaggtttcctggtgaggctgatgccgctggcccagggttctcacgttgaggaccgagagctttgaggttttcatacctgatgatgtccaggaacccttctcagtaggcactgaagaccatcagcagaatcacagaccccaggagagatgtcgtcagacagacacagaggcatcaccgaattaaagtgaaaatgaagaaaggagctgagcatctgtttcatgactttcgtggctgttttactaaagaggctatcctggcccagtcagggcacgctatcatcaccaactacttgttgaactacgttcagggtcttgatcttgaaggagggacgcgttcgggttgaaagccgccatgcagggtcgaacggatcgcatcggagccctgagctagcaggggcgggtgtccacgcgagggcccccgccgtgggatgtcgccagaggagtggccacttatacgtccgcctcatgcagaggctcctggagcgcccctgccgggagctgttggggaaaaagtaccagcttgagctgccgccgctccccgagaggccgcaaaagcccgagggctccaagaactgcctgcagaggctcagggactgcgagctgtccgcgctgacgccgcgctccatgcggggcccagaggaccggggcgccctggaccacatggtcaggatgaccacgagcctctaacagccccgccggggccctcgcgtgccagactatgtgccccgagagcaccttgtgctgggggaagaggcggctggcggtgcaggaaatcctggcggcgcaggaaattccggcggcgcggcgaggggtggggggaggcaggcgcaggaggcgggcgaagaggagggcgcagagtagcataagccgctcggcctagcggccg

SEQ ID NO: 294265 - DNA, 345 bp, Homo sapiens
ttttttttttaactcaagcaacccacaggccggtttaaagtggtctttaattactgaagactttcccttatttaaagaaataggggaaacttggaggtctagattagatttctttccaacggttgctatgtaactttgtgacatttgaaagattaaagttgcttctgacggcactacagtagaacctcaatatttgcatgtttcttccttaaatttcccctttccctgacactgtacatacactttctaaaatttgttttttaatttttacttttcacttttcaatttttaaggaaatagagatggggtttcaccatgttgcccaggctggtctcaaactcctgg

SEQ ID NO: 294266 - DNA, 1445 bp, Homo sapiens
tgggtccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactagagctccaggagggccagttctgtgggctctagtcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccactacctacaacaagcacattaacatcagcttccacaggtaacctgggcagggagtgggggtgacggaaactggagttcctattgtggctatctcttgtgtggaaggaacaggaggattctgctaattctaataactttcccagctggtagcagggaagcatcgtatgtcctttgtgtttctcaaatctgcccaattgttctctgctttcggggaagctttactcattttctaaaagaaatccaagtactgtttggtcattaccccttagtaaaaaaaagtaacaggaggatatcgtaattttctactgttttattcctctgttagaccgggccttgacatgaatgacgccgtaagggagaaagagatcttcccaatcagcaatcaccgtaaaagcctgctgtgttcccgttaaaattaggaaattctcactagatgaattgacatgggaggcatttagatttctaatagtcacatagtaattctgcggaggaattgagtcatctttgatagccatggaattaagcgatgttaattaaagtgcaaaagataacctttctgttcttactagaatagagtaataaaaagaacctaggttttcttttgtttgctggaagaaaaatcaaaattctttagttctgtcaaaccagaactcttgaaagcactttgaacaatgcctggaaaataacaggtactctgtaaatgtttaccttctctgcaagtgcctgccacgtgcccgaagaaaagacacattaaaaagttaagtgacaccagtcctgattttatatattttatatacctaacaacgtatatgttagtatgtagaaattatatccttgacctttttccctacctattacgaactgtacttttattaaaagctgccacttaaaaaaaatcttg

SEQ ID NO: 294267 - DNA, 4741 bp, Homo sapiens
tgggtccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactagagctccaggagggccagttctgtgggctctagtcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccactacctacaacaagcacattaacatcagcttccacaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaaagaatttagaagcaaatagtgtattacctaaaggtacatcagaacacatgttaccaactgccttaagcagtcttcctttggaagattttaagatccttgaacaagatcaacaagataaaacactgctaagtctaaatctaaaacagaccaagagtaccttcatttaaatttagcttgcacagagcttgatgcctatccttcattcttttcagaagtaaagataattatggcacttatgccaaaattcattatttaataaagttttacttgaagtaacattactgaatttgtgaagacttgattacaaaagaataaaaaacttcatatggaaattttatttgaaaatgagtggaagtgccttacattagaattacggacttaaaaattttgctaataaattgtgtgtttgaaaggtgttttttgtttttgtctttttaaactactgttaaaagaacagcttatgataagtaatatgtttaacttagagaagaattttttcctgtaccaaagttggcatattgcattctaaataagatgctaaataagagttaaccaacattcaacatgaccttaaaactgctgggttttgtattaattaaattataattggcactgtgatttgaaaaatttatagaaaaaaaggtacagggcaagtttttaaattaaaactttctatattttgttttaccagtaaaagtgagcttatcatggcctctctcataagaatgattttaaaataggttgtaaaatattttgaaaatatttgaatgtgaagtaccattgagtcatccaaactaggtaaggcctcaagtactttaaactagtaaaatctagtagctgataatattcacctaagtaagtgttgtaaaataattcagagttcaggacctagcttagataaatgtatactactctttttctcatagtaaaaatcttacatttccaacttcaaaattggtgcttccatatttgttgataaccaaaactcctaaggttttttgttttctttttaactactttccaaatgcatactatacctcagaaatagtgtatcaatatagtgggctttttttttcctcttcataaacccacagtaaaatttaatcacaggaaactacttatatcttcacactttgtattgataacttaaaatggcatcagtttatcttagacatcagcttgctttttatctccttttttagtgagtgaaatagagcaactagcatgcctgtgttcccagctacttgggaggctaaggtgggaagatcaattgaacctaggaggttgaggctatagtgagctgtgattgcacgactgcactccagcctgggcaatggagtgagactcctgtctctaaaacagcaacaacaaaaataaagcaaccatagtgcataagggaaattaaatgttccctatagaaatatgtgtatgtctgtgatagtggtatgcaaatgctaattattttataaaataaaagttcagaactattcttatcattgccacttgaacaattaaagggtttgctttatttcactaatgtttaataggaaccctttgcttcaaacagctttgttgaaatcatgtaaaaatttgttaatagagaatcaagttatttaactcaacttatttaattcaagcttgtgatactaacatacaaaggtagcataaaccaagtcataaattgctgtaatctttcctgtaaagtaatagctacttcatgatttttttaaaaatttcatttttttgctatttaggattgcatttgcttggctcctagtaacaattcttttacagtattagcactctctttactaaggaatgcctcccaaggaaatgcaaaggtaggaaaagtctcttagaatgcccatgaggtatttaaaacagatatttatgaaaatctttttgtgaatgttataaatcttgctagttattttatctttatcttaagtattagatgtagttccttggaattgtcattacatatttatttttttctagtatggtttcaaataactttttgccaacatataatcatcatcaaacattcactgaccatatctattttataactcaaaataagttggacaaataatcattttaataaaaactattttttccaagtataaccactgtcatgtggttcacccttcaccccagatacaaaacacttatttgtgtagcccagttcccatctacagtaataccttgaaaccttaataaattttaaaaatcataaaaataaaatattgtaaaatacaacaaattttggacaaggttacttcatcttcattcattattacctgacagtattaaactactactcaataattttagagtaaacttttctgtgttttccccgtgattttcattgtgctgtcctgacaacatgctccaaactctttgcatcaaattgttttattaacatacatttgtctaccttaaaactagctttattcacagagaaagacctaaaaggagtctattaaaatgctgctttcagtttgatagttttttttttaatcactctgaccataaactaactgaaattataatggattttttttcctctcccggtcacaacacagatcttctgttcatttgttctctgtctactgggcaccaacctctacaaagaaccagccaaaggctaggtacttgatataaaaaggaatattacattattttctgccctcaagttgctctatctcctgaaagaaacaagtaatatttataatacaatatgataaatgctacaaaagaaatagctgtaaagtcctttggtaaatgctgttgaattggaattcagtaagaactataaactgtagacctttttataatcaaatgcttttgtcttgaaacaaaacagattcctccttatattgacttagcaaaggaggtacaaggacattggcatttgacctgaattatggtgttttattgaatgagctataagacaacatttttaccctttaaaatgaacactgaacaaatgtgttaatggtatctttgttaaaaggaaaacatagctataaataaaatactacatcgaaatccagcactggagttcatttgaaatttgatattttgtgtaaagtaacaaacctattaacacagatttttaaaataactcagaatcgtataaagcactttggtacttatttgttctcttttcccttacattctgtgtggtaggtggtattatctctgatttacacatgaagacatccttgttaatgcaatttatttattcattcgggcatttactgtgtgccaacttgcaaaaggaatagaaatgtctgtgatctagatagttctagattgaacatagattttctgccaacaaatcctctctgctgttcacattatcctttgtttaacgtatgaaccaggttactaaaataggataaatcatgtgtcttaaaatatgaaaatagtaaagtctttgaggtcacttgatcttctctaagtagactttataatattgtgttttatctcatttctcaatattagaatacgggtagattttaattttgctataatataggaaatggttcatctttgtaccaaaatattgcattcttctgatatttagacagttggaaactttctaaaattgaggattttgtagtgtatactaaataattgcatattcaaaaaaatgtattctgagtatggtgatattaaacatttttccccaaggaaaaaaagtca

SEQ ID NO: 294268 - DNA, 1439 bp, Homo sapiens
tgggtccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactagagctccaggagggccagttctgtgggctctagtcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccactacctacaacaagcacattaacatcagcttccacaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaaagaatttagaagcaaatagtgtattacctaaaggtacatcagaacacatgttaccaactgccttaagcagtcttcctttggaagattttaagatccttgaacaagatcaacaagataaaacactgctaagtctaaatctaaaacagaccaagagtaccttcatttaaatttagcttgcacagagcttgatgcctatccttcattcttttcagaagtaaagataattatggcacttatgccaaaattcattatttaataaagttttacttgaagtaacattactgaatttgtgaagacttgattacaaaagaataaaaaacttcatatggaaattttatttgaaaatgagtggaagtgccttacattagaattacggacttaaaaattttgctaataaattgtgtgtttg

SEQ ID NO: 294269 - DNA, 3095 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294270 - DNA, 4514 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294271 - DNA, 3179 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294272 - DNA, 2873 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294273 - DNA, 3925 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagctgacccatctggatggcttcattcctttggcacccctgtccagtctcccacccctcactggccagcttactgggggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294274 - DNA, 3228 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagtcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294275 - DNA, 3643 bp, Homo sapiens
  misc_feature (24)..(24): n is a, c, g, or t
cggcaaatagctaggactgaaggncggtttatcggcgaggggccccacgtccgccaccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294276 - DNA, 3518 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccagtggttggagccccagggtcgaagtcgctggggcatggggaaaggggcgacggcccgcaaatagcagggggacacataggagggcggggaacgaaaacctgcg

SEQ ID NO: 294277 - DNA, 3403 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgcccccaaccctgtggccccgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294278 - DNA, 3570 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgcccgcaagcccctcacctaccagacaagaaccacacggctcttaccgccatcttggctcctgtggaggcctgctgggaacgggacttctaaaaggagctatgtctggaaggctgtggtccaaggccatttttgctggctataagcggggtctccggatccaaagagagcacacagctcttcttcaaattgaaggtgtttacgcccgagatgaaacagagttctatttgggcaagagatgtgcttatgtatataaagcaaagaacatcacagtccctcctgg

SEQ ID NO: 294279 - DNA, 2918 bp, Homo sapiens
ggtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaggctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaagc

SEQ ID NO: 294280 - DNA, 521 bp, Homo sapiens
cgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcaggtcggaggagatggaggagccgcccctcccgactcctcgccgacggacatcaccccgccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggc

SEQ ID NO: 294281 - DNA, 1070 bp, Homo sapiens
cctggtacggtccgcagttttgggacaactgtgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtaacaaaacaaaaaaaacacaagtcgagc

SEQ ID NO: 294282 - DNA, 1077 bp, Homo sapiens
ggctaggtgaggccgtgttttatcggcacggacaactgtgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtaacaaaacaaaaaaaacacaagtcgagc

SEQ ID NO: 294283 - DNA, 906 bp, Homo sapiens
ggcaaatcggaggtcttgcttgcccagcctccggggagccgggccgagggccgggactgtctgagggaggactgtgacagccgcccggccccaggagtttaagagccggcgggaagaggtggcgatgggttactcagcagttcccaagtgcccacctcgcgggcgcgggagggacagtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtaacaaaacaaaaaaaacacaagtcgagc

SEQ ID NO: 294284 - DNA, 821 bp, Homo sapiens
ggcaaatcggaggtcttgcttgcccagcctccggggagccgggccgagggccgggactgtctgagggaggactgtgacagccgcccggccccaggagtttaagagccggcgggaagaggtggcgatgggttactcagcagttcccaagtgcccacctcgcgggcgcgggagggacagtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaaaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtaacaaaacaaaaaaaacacaagtcgagc

SEQ ID NO: 294285 - DNA, 907 bp, Homo sapiens
ggctaggtgaggccgtgttttatcggcacggacaactgtgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaattgggtgctggtatctcctctaagtaaggaagatgctggagaatatgagtgccatgcatccaattcccaaggacaggcttcagcatcagcgaaaattacagtggttgatgccttacatgaaataccagtgaaaacaaggtgaaggttgccgagctataaaacctccaagaatattcatttagtctggcatggttaacagtagtccttggataactacgattacctggttcttgcctaataagtttcttttaatccaattcactaacacttaagttatattcactgggttttacacacgagacattcccattaaggagtcaccctcaggactt

SEQ ID NO: 294286 - DNA, 557 bp, Homo sapiens
ggctaggtgaggccgtgttttatcggcacggacaactgtgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatgcacatggacactcggacggggcatggccatcggaacggggggg

SEQ ID NO: 294287 - DNA, 2140 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294288 - DNA, 1336 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacagtgagcgcttgtatcagtggattttctcatggctgatttaattgttctgtttgctttttgattacctaacctttctgtgtattaatttccatatgtgtaacctaagaaaattaactatgtgcatcatagcattgttatgaggatgatatgcattcatgtttacccaacacttggaaccctgctgacaacaaagcatggataataagtctgttgaagtatctggatgtgaatcctttagtgattctgagagtcacaaacacattcatttctgtctgtctcctactcgtctacaattatgtacactttttcacacttagtatagtttatatactgtgtgtgagtatagtttatagttatataatatagtttatactataaactatacagtgagtataaactatacagttatagtataaactatatagttaggataaattatagtttatagttttatagtatagtttactataattatagtatataagtatatatactatgagtatagtgtacagactataatttatatatagcttgtatactataattatagtatatatacttatatataagtgatattttatttattgtttggttcaaaatatcttctaactttcaatataatttcttctttgccccatatgtaatttagaagttttctttattat

SEQ ID NO: 294289 - DNA, 2124 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagtcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294290 - DNA, 2163 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcataaacacacaccaaaaagggcggcc

SEQ ID NO: 294291 - DNA, 971 bp, Homo sapiens
tcggtaccactattcacggttggctcataagaaggaaacgaatgtgaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294292 - DNA, 1710 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttgcccgccaatcgaagtgaacctctaga

SEQ ID NO: 294293 - DNA, 896 bp, Homo sapiens
tcgaagctccgttaaccctaagcccaggtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294294 - DNA, 853 bp, Homo sapiens
gatcacgcggagtatatggggtgtgaattctgactgctaccattgtctcacagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294295 - DNA, 1555 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggccatctcaccatggcattgatacgggctgggagggcaaagagctgatttgcgagggaagggttagccttggtatgattgagaacacagttcatc

SEQ ID NO: 294296 - DNA, 1190 bp, Homo sapiens
tttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacaccagaaagcagattctccaatggatgacttctttcagtgtgtgaatgggaaatacatttctcagatgaaagcctgtgatggtatcaatgattgtggagaccaaatgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctt

SEQ ID NO: 294297 - DNA, 293 bp, Homo sapiens
tttatattggtggctgttggattctgactgctgcacattgtctcaggtaaaagatgtcttcagtaaattttagatttcccgaaacaatgaaagtgagtaatagagattgtggcagatgataaagcatatctgaaaaaggtactgacaaactccactatattaattgcaaagtatcctctggtattcgcgactggaattccagaggctaatcccgtagaatctactgtgtcctccacagaccaaaattgctgatctcactggcaaaggcagatcaaacccatagctgccaaatt

SEQ ID NO: 294298 - DNA, 544 bp, Homo sapiens
gagagcccatgctattgctgtcaggaaactgtaaaaaagccaaagttgttaaatgccatggaggaggcatggcagccttgaaaaatggaaggaaatgtgtgattttctctttcacatttctttcttaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcata

SEQ ID NO: 294299 - DNA, 1452 bp, Homo sapiens
aatgttataaagccatagtaatcaaaactgtggtattggagaaaggatacatagatcatcagaacagagcagagcagagcatccataaatatgcacacataaatatagtctaccaaaatttacaatagtgcaaaggtaattcatttgagaaagtagtcttttcaacaaatggtgatgaaacacttggatatccatatgcataaaatgaaacttgatacacattttatgtctcatacacaaataagtcatgaacctaaatgtaaaacataaaactatacaacttctagagcaatggtctcaagtggtagtaacttttgtctccaagaaacaaagtatagagacatttttgactgtcagtacttggggggaggagatcactggcatctaatgggtgcagaccagggatgtcactaaatatcccacaatgcacagcacagtcaccatcacacacacgaaaatgccaatttctagtctggataaatataccatggttatgtaactatctcttattagaggaacagaaacttggtaaagagtgtatgggaatgctttttactccctttgcaactcttcagggcaatagactatacttcaaagtctaacatttaataatttcctattctatttctgtgaaggcatcatgtactgtagcagatgtattctgctttgatgtcttgcaaaatcactttgattcttcaattaaatttattaaatgtgtaaatattgccagtcatgtattatatgttaaaaatttgagaccaataaaatattttcaaatgtctcctctttataggagctttcctgtttcatctaacctaaaataccacctttctccaccaatctttctgatgttctccccatggaacttttttctgactgttttcccttttctagggtatatgctccatgaaggcagggactttgttgtacctccagggccagaactggcacactagagatggatgcttaataaatatttgttgagtgaatgaattatatgtatttgtgttgcgtcttcccaataagtggtctttattcaaacgttggagcttcagtaaacccctatttggctgtgaacagattagtctcaatcctagtatttaatttaccccgagtgaaagtaacacctttctcttaagcagcaagatgcattaatctttacgttaagatttttcatggcaaaaaacaaatccattttttttcttccctttcttcagctctggggatgccaggcaagaaggagatgacggggtagataatggttactttgtaattttctggaagatcatgctggttctactagaagacttttacctcacatgattggatgctcctcaagctgaacttcttccatttgtgatagtatttggaccatttctagaatatgttataagatttttataagattgtctttccaattaaagttttaggttaaagttctaaaaaaaaaaa

SEQ ID NO: 294300 - DNA, 568 bp, Homo sapiens
tttctgtacattggaagacaagctattccacttgagctggtactgcagatgtgacctcaagaaatttggttaatgaaaatgctgcatctctgatctgcatctccactttctcccagcgggtcctaccatttggcccttgttccctgcctcaaaaactggcccagccccaaactcactggttgccgtgggaaagatgcctaaaaggtgtttgaagatgaggaagaaaagggaagttctgggagctggtgaagaaacccacaactcctcaaggtcagcccatggggaagagctaggagctcagaatccaaccagcaagaggacattttaaaacagctctggggatgccaggcaagaaggagatgacggggtagataatggttactttgtaattttctggaagatcatgctggttctactagaagacttttacctcacatgattggatgctcctcaagctgaacttcttccatttgtgatagtatttggaccatttctagaatatgttataagatttttataagattgtctttccaattaaagttttaggttaaagttctaaaaaaaaaaa

SEQ ID NO: 294301 - DNA, 2896 bp, Homo sapiens
tgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagcatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaaacaaaagcggatcctctagagtcgacc

SEQ ID NO: 294302 - DNA, 2869 bp, Homo sapiens
tgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagcatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaa

SEQ ID NO: 294303 - DNA, 1841 bp, Homo sapiens
  misc_feature (74)..(74): n is a, c, g, or t
cgctctgaacttaggcctggctctgaacttaggcctggctctgaacttaggcctggctctgaacttaggcctgnctctcaacttagggaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaa

SEQ ID NO: 294304 - DNA, 367 bp, Homo sapiens
gcggccgccggcgcagggtggggagccaggaagcggcgcggcccggagatcccgcctcccgcccatcccagcgcccggctcccggactgggcggcccggcgacgcgggggggcttctggcctgcgcccggctgccgtgtgcgccgggtgcccgccacgacccatgtcgcccatgccccaagtgccctctgccttccctccgcagaaactggaggcctgccaccaagccccaatctctgcctcagtttcctcatctgtacacaggccccataacactggtgccagcgcttggcaggagccagcacgtggaagtaccctgtggggcgattcctgctattgtcctcatcttcccggagctggagctccct

SEQ ID NO: 294305 - DNA, 680 bp, Homo sapiens
gagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaataagcagttgggctcgttgaaaaagaagttcaagagtcatcaccgcaaacccaagagcttcagctcctgtaaacagccaggttaataaaagcaaaaaaaaaaaaaaaaaaaaaaaacttcgaagggcataaatggccgggggtggcgggaagaaagaagggtattggaaattgggcacttggggccaatagtgtggtttcgtggaccaaagttttttttggtaccaagtgtgggtagattgggggggtccccctaataagggaggccggtataaattgcaaaaagccgggtgatcgtggttgatg

SEQ ID NO: 294306 - DNA, 1030 bp, Homo sapiens
gagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagagcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcaaaaaaaaaaaaaaaaaaaaaaaacttcgaagggcataaatggccgggggtggcgggaagaaagaagggtattggaaattgggcacttggggccaatagtgtggtttcgtggaccaaagttttttttggtaccaagtgtgggtagattgggggggtccccctaataagggaggccggtataaattgcaaaaagccgggtgatcgtggttgatg

SEQ ID NO: 294307 - DNA, 1196 bp, Homo sapiens
gagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtccgcggcggcgcggggaggcccagggcaattaggacagcccctccgctggactccgccagtgctgcagcccctactctttcagagttgggagccctgggacccaggtgggcgcccgggtgctggaatcacctgcggtcccagcggcgaggcctcttggcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagagcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcaaaaaaaaaaaaaaaaaaaaaaaacttcgaagggcataaatggccgggggtggcgggaagaaagaagggtattggaaattgggcacttggggccaatagtgtggtttcgtggaccaaagttttttttggtaccaagtgtgggtagattgggggggtccccctaataagggaggccggtataaattgcaaaaagccgggtgatcgtggttgatg

SEQ ID NO: 294308 - DNA, 274 bp, Homo sapiens
tctgaggccctgctgagcggggtctaatcctgcagctgttaaggaaacgggggtggagaaagcctctgtgggtatttgaccgacacctctgaggctgtgtgggtggggagagccctgcactccagggccccttctccatgggatcagaaaggctcagtaatcagaattttgtttatcccacagaagcagttgggctcgttgaaaaagaagttcaagagtcatcaccgcaaacccaagagcttcagctcctgtaaacagccaggttaataaaagc

SEQ ID NO: 294309 - DNA, 431 bp, Homo sapiens
aattgggcgcattgcatctgattcagcctcttgaggagaaagacttcatactgatccaaatagactcccgagaggcagaaagaggaaaatgataaataaatgccagccaagctctaaaatggaacactctagctgtgtggccactgctttaatgaagacagctgccattctgtgagctgttctatgaaggagcccacttggcaaggaactgggggaggtctcagattaacagccagcaagaaactgaatcctgctaacaaccacctgaatgaacatgaaagcagacccttccccaattgagtcttcagatgagacccagtgctcacctgcacctaggttggagccctaagagaaaccttgaagcagaggaaccagcttaacctgatccatggaaactataaaataaaatgtgtgttgtttaaactgctaaa

SEQ ID NO: 294310 - DNA, 610 bp, Homo sapiens
acaggcgatgggctataggatgaggacctgccagggccaagaagacacatttcagaaggaggctcttaaaggccaagccaagaagcaagagcacggatttacatctcattggctgagggtgctccaggaatttctcacacagaagcgtgagtggctgaaacgaagagaatggacatggagcccacccggaagagcacccttaacatcatcatatccctgaagcacgagtcggggtggtgggactgccctggaaaccctgcacacagctggcttgagcagtgggtattttcataaggcatatatgggcatcacagaacacttggagctttaatgaagacagctgccattctgtgagctgttctatgaaggagcccacttggcaaggaactgggggaggtctcagattaacagccagcaagaaactgaatcctgctaacaaccacctgaatgaacatgaaagcagacccttccccaattgagtcttcagatgagacccagtgctcacctgcacctaggttggagccctaagagaaaccttgaagcagaggaaccagcttaacctgatccatggaaactataaaataaaatgtgtgttgtttaaactgctaaa

SEQ ID NO: 294311 - DNA, 396 bp, Homo sapiens
gtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggttcgtctgtgtttttgcaaatgacatgttgtcatgaatttttatgcatgaggcatatttcatcatgtctgtatgctgaagtcccttcatcctttcattggttggtggacaggagagagaggtccaaggtgccctacatcgtgcgtcagtgcgtggaggagatcgagcgccgaggcatggaggaggtgggcatctacc

SEQ ID NO: 294312 - DNA, 371 bp, Homo sapiens
gtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggttcgtctgtgtttttgcaaatgacatgttgtcatgaatttttatgcatgaggcatatttcatcatgtctgtatgctgaagtcccttcatcctttcattggttggtggacaggaaagagaggtctaaggggcacatacttcatgcaccagttcgtggatgatatctagccctt

SEQ ID NO: 294313 - DNA, 1584 bp, Homo sapiens
agtggcggccgggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccaggcagccagcgaagctctaggcaaaaggacatggaaactgtcacgttagctactgaatcctgggggcgagtgaaactactgaaaatccgagtgatgatgttgtgaatacggaacaccta

SEQ ID NO: 294314 - DNA, 679 bp, Homo sapiens
ataaaatgtactcaagtcacatataatttctacaccactcacaggttgtacaactgccatgcaaatgcatttcagatttactttttttttacacagtgaaccttcttgatttttattttggtttattttattttactttattttattttaaatatagggtcttgctctgcactccagcccaggcgagagagcgagagtctgtctcaaaaaaaaaaaaaaaaaaattcgaaatgccctttttcttaactccatttgaaccagctcacatcgatgggcacaagcgtcgccaggaaattcagtgtggtaagcttggcacctactcatggccaccgtgtcctgaactccctttcctgtgctcaggccccagcccacgcagcaggaggacacactgccgaagggaccagttggacggccttctggctttagcgcctgtgcctttcaggaccttaaatacagaaaggaaccgagtgctctgtgcagcccctccaagacggtcgctacagcgccagcaccacctgcgccgggccatcatgccgtgaccggacttggtttacgaatacagtgtacgaggttaagatatgataaagtgtaaaaatatatgttatagccacggtggttagtttaacatgttttgtatatatgatttttataaatctattaaaatgtgccttaaattaaa

SEQ ID NO: 294315 - DNA, 533 bp, Homo sapiens
tgagatggaattttgctcttttgcactccagcccaggcgagagagcgagagtctgtctcaaaaaaaaaaaaaaaaaaattcgaaatgccctttttcttaactccatttgaaccagctcacatcgatgggcacaagcgtcgccaggaaattcagtgtggtaagcttggcacctactcatggccaccgtgtcctgaactccctttcctgtgctcaggccccagcccacgcagcaggaggacacactgccgaagggaccagttggacggccttctggctttagcgcctgtgcctttcaggaccttaaatacagaaaggaaccgagtgctctgtgcagcccctccaagacggtcgctacagcgccagcaccacctgcgccgggccatcatgccgtgaccggacttggtttacgaatacagtgtacgaggttaagatatgataaagtgtaaaaatatatgttatagccacggtggttagtttaacatgttttgtatatatgatttttataaatctattaaaatgtgccttaaattaaa

SEQ ID NO: 294316 - DNA, 1081 bp, Homo sapiens
gccttcttgctgggcacctgatagtgtgttttttacatgactattttggaccgttagttgaatttccttaaaaactgtgtaacagtccaagcaagctctaaatcaccgtaagttgtaatgatcaacaaccaaaacacgggatggaggcagatgctatataaaaggctcaagaggggaaggagcaagagccactcagggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccaggcagccagcgaagctctaggcaaaaggacatggaaactgtcacgttagctactgaatcctgggggcgagtgaaactactgaaaatccgagtgatgatgttgtgaatacggaacaccta

SEQ ID NO: 294317 - DNA, 1018 bp, Homo sapiens
agtggcggccgggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctggccccagcccacgcagcaggaggacacactgccgaagggaccagttggacggccttctggctttagcgcctgtgcctttcaggaccttaaatacagaaaggaaccgagtgctctgtgcagcccctccaagacggtcgctacagcgccagcaccacctgcgccgggccatcatgccgtgaccggacttggtttacgaatacagtgtacgaggttaagatatgataaagtgtaaaaatatatgttatagccacggtggttagtttaacatgttttgtatatatgatttttataaatctattaaaatgtgccttaaattaaa

SEQ ID NO: 294318 - DNA, 286 bp, Homo sapiens
ggcatgcagggctgtggccagcagcgtgaacccctcgagactgtggcacccctcctcctcctcagtccgacagctggctcccaagggatctcccgcagcctcggggtgatgcaggagatcttcgccaccaatgtgtttcccatctgtgctcctcaaagaaggtcagtacaaactaggccgaggacacttggtcaggtaggagactttgaaactcgggcatcaagaactgaaccagacctgcatctggaaatcacacgaatgaagttggttctttgtggctctcccg

SEQ ID NO: 294319 - DNA, 1214 bp, Homo sapiens
ctaatttaggggttctgggcacagacatctaacctggtattgtaaggcagaggctcccattggaatggtagtggtccgggtcagttgttcatggtgtgatcatagctcatcgcagcctcaaaactcctgggctcaagcagtcctcccaccttggccttccaagtagctgggaccacaggcatgtggccaccacccgcacctggctaatttttaaattttgtatagagatggagtctcactgtgttgcccaggctggtgttgaactcttggcctcaagtgatcctcccacctcagccttcctgaagtgctgggattacaggcatgagtcgctgcacccagtctgggttcttaacaagcctatgcaaaatttaaaatctctgttgcatctgtcagtctcgaatctcaaaaaattaccttttgacctgtcaggcaaattggtttaaaacattcaaaatgtcctggctgggcacggtggctcacgcctgtaatcccagcacttggggaggctgaggcggatggatcacgaggtcaggagatcgacaccatcctggctaacacggtgaaaccccgtctctgctgaaatataaaaaattagccgggcatggtggcgggcgcctgtagtcccggctacttgggaggctgaggcaggagaatggcatgaacccgggaggcagagcttgcagtgagccgagatcgcgccactgcactccagcccaggcgagagagcgagagtctgtctcaaaaaaaaaaaaaaaaaaattcgaaatgccctttttcttaactccatttgaaccagctcacatcgatgggcacaagcgtcgccaggaaattcagtgtggtaagcttggcacctactcatggccaccgtgtcctgaactccctttcctgtgctcaggccccagcccacgcagcaggaggacacactgccgaagggaccagttggacggccttctggctttagcgcctgtgcctttcaggaccttaaatacagaaaggaaccgagtgctctgtgcagcccctccaagacggtcgctacagcgccagcaccacctgcgccgggccatcatgccgtgaccggacttggtttacgaatacagtgtacgaggttaagatatgataaagtgtaaaaatatatgttatagccacggtggttagtttaacatgttttgtatatatgatttttataaatctattaaaatgtgccttaaattaaa

SEQ ID NO: 294320 - DNA, 583 bp, Homo sapiens
tcccgctcacccaggctgtctggatgcacccgggtgcatgttgccacattcccctgcaaacaggtgccagcagctcttgtgacttagctgtgggtgacaggtgctgagcacgcgtctgcagcagggcccccacacagcccacaggcaccgtgggctgtacactctgtggtgctttcttattaggagtcaacctgttcaatttttttttcttcttttataaaatgtactcaagtcacatataatttctacaccactcacaggttgtacaactgccatgcaaatgcatttcagatttactttttttttacacagtgaaccttcttgatttttattttggtttattttattttactttattttattttaaatatagggtcttgctctgtggcccaggctggagtgcagtggtgtgatcatagctcatcgcagcctcaaaactcctgggctcaagcagtcctcccaccttggccttccaagtagctgggaccacaggcatgtggccaccacccgcacctggctaatttttaaattttgtatagagatggagtctcactgtgttgcccaggctggtgttgaactcttg

SEQ ID NO: 294321 - DNA, 1490 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294322 - DNA, 920 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatgca

SEQ ID NO: 294323 - DNA, 1544 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294324 - DNA, 2517 bp, Homo sapiens
tttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagcgctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaatta

SEQ ID NO: 294325 - DNA, 1478 bp, Homo sapiens
tttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294326 - DNA, 1970 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatataggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294327 - DNA, 2018 bp, Homo sapiens
gatacgtaccgatccgcgggcgctacgcgcgcagctacggataaattaagttgctacatgattgatctgtagcagagtcgcggtaataactacggtgctgtggccatgctcacttcctgaagatacacggcaccgtgcggccccagcgcagccgcttcttgcgagcgacagattccgagcatgcgcggtgctgcatggtcgacgtctacgtggtgtctgagtcgagctcggagctgcgacgcgtaggcttgatcctcggagtggtccaggccacggcgtgcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatataggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294328 - DNA, 1607 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294329 - DNA, 1670 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctggagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294330 - DNA, 2116 bp, Homo sapiens
ggctgcaggcagctgggaaccgcgggcgctaggcgcgcgcacccagcgactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatataggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294331 - DNA, 1379 bp, Homo sapiens
  misc_feature (139)..(141): n is a, c, g, or t
gctggcggctcgccttgactgctaccttcgggggcggctgacacgggcctcactgcatcttggcaccgcacgacggctctatcacacgcgcgcggcgccctctgactgaccaggcatataggtgccactcgtgtatctnnngaaattacttgttgagtgcacagaaacgttttgataagaatggttctccactagatgactctgtttagatcacaagctgatagttatggcggaacagcgattgagagacgttgtcacactctgcacgtcgtcttatattaatacaaggacacttctctgcacggaactttaatgtggtatctcgtgatgaggttggcatcccatttaccgagcaggagaaaaccatacacagggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaaataggccaggcacagtggctcacacctgtaatccagcactttgggaggccgaagtgggcggatcaccagaggtcaagagtttgagaccagcttggtgaaaccctgtctctactaaaaatacaaaagttagctggggctggtggtgggcatctgtagtccca

SEQ ID NO: 294332 - DNA, 1303 bp, Homo sapiens
gacccgcgcagccgcgttcgccccctcgaggtcgtgagcgcgcgtgcccagagcaacgggcattgtcgcctgaggcaggcgactggggattggccccgcccccggcttccgcgcggattggctggggcggggcggcgcggctgcagtaggctagagagtccgcacctgcgccgcggccgtggggagagagggtgcgtcccggcagtcccgcacgacgggccccgcctcccctggtgaccccacgctccggcctcggggggagtggcggtcggcgcgccgagaccctcgggagccccgcccagacgcctgctccgcttccaggccacccgggctctccagccgcgctcgctcgtagagatcctagacgagttcgacagcgaggtcccgcagagcaagacctgccagcagatctccgaggaggacttggagaggcaggcggacacctacactgggcgcgcgctgcgcctcctcttccgcagccccgtccgcaacccgtcgctggcggagagggtggtacaattggaacagcgcgggctctcttttttccggatgcggccgcggggcatgggaccggctgggcgggaactgtcactacccgggtccgccgtcccctaggaaagagctccgacgattggagctttgggggccggggatgggggtggggtggagaggtcgccgtcggcctagctggggctgcagggtaggatctatcagaaagccgaggctgcacagcctggggagtggagcgggcaggcgtctcacgccccggacctccccctgccctgcctctcctactcttgttgcaggcgaagttcttctgtgttgtgcaggcggagctgaaccattgcaacagcatgggcgccctggagatgcacgagcaggtggagcagctgaagcagagcatccaccgcgtgcacctctactcccggggcgaggatcaacctctccccgtgctgggccctgggcgggggtctgagcccagtgcagccaggccgagggctaggtgaccacctccattcttccggttggatttgccctccttggatcaggttttatccagagcaggaaggggcctgggcagtctggacctgggaggagaggcgctgcccctagctagattctttagttaggagactgacttcagctctgctacttccttcctggctgtgtgatcctgagcaagttgggccacctttccgagagagagagccctcactgctcaccttggtgagtgttttggagtggtggatgaaggcctgtaggtagggctggctcaagcaaccaagcaaacctgaatcaatta

SEQ ID NO: 294333 - DNA, 1457 bp, Homo sapiens
tatagattttaaagtttcattttgtaagtcacaccagggcaggaagtagaatagagatttgagcccaagtgtacctgacaagtctctctgcctgcactcctagacaagatgatcaggacagacctcattcttctttggttgtccccaggcaggaggaaataaatgtcacttcctatgttggaagagctgaggggtggtggtttagcagtaagagatgaaaaatctgattaaacgtctcaggcacactatggatctcagggctgatggaggacaaggaggggacaagggaggacgcagtccagggtgcacccccttgttagtggctggggtcagtggctgaccaagtaggaggggagaggggtaagaaaagtagctttcagggagaagaagctgtgcgtgaatgtggacatgttcagcatgagatgcccaagaatcgtccccagtggtcatttggatgtgggtctggagctgaagggccacccgggctctccagccgcgctcgctcgtagagatcctagacgagttcgacagcgaggtcccgcagagcaagacctgccagcagatctccgaggaggacttggagaggcaggcggacacctacactgggcgcgcgctgcgcctcctcttccgcagccccgtccgcaacccgtcgctggcggagagggtggtacaattggaacagcgcgggctctcttttttccggatgcggccgcggggcatgggaccggctgggcgggaactgtcactacccgggtccgccgtcccctaggaaagagctccgacgattggagctttgggggccggggatgggggtggggtggagaggtcgccgtcggcctagctggggctgcagggtaggatctatcagaaagccgaggctgcacagcctggggagtggagcgggcaggcgtctcacgccccggacctccccctgccctgcctctcctactcttgttgcaggcgaagttcttctgtgttgtgcaggcggagctgaaccattgcaacagcatgggcgccctggagatgcacgagcaggtggagcagctgaagcagagcatccaccgcgtgcacctctactcccggggcgaggatcaacctctccccgtgctgggccctgggcgggggtctgagcccagtgcagccaggccgagggctaggtgaccacctccattcttccggttggatttgccctccttggatcaggttttatccagagcaggaaggggcctgggcagtctggacctgggaggagaggcgctgcccctagctagattctttagttaggagactgacttcagctctgctacttccttcctggctgtgtgatcctgagcaagttgggccacctttccgagagagagagccctcactgctcaccttggtgagtgttttggagtggtggatgaaggcctgtaggtagggctggctcaagcaaccaagcaaacctgaatcaatta

SEQ ID NO: 294334 - DNA, 480 bp, Homo sapiens
ctctggggagaggacagcatcaccaccttgggtgtgagaggactcactggagctgggaacccttgctggggctccaggagaggagaggtgggcccaggtggggttcacagagaggagccaggtccagaccagggtctccttgttacctggacacctaagggtgctcccagacgaggcctttgtactgtttgtctccctttgactagaaacttcttcccccagataaaacaaagagccgggtgcacccctcatctccctcaggccttgttcaagtatcaccacactggcaaggcctttcctgaccacccctccctacctcttcccgccacgggacaggctttgtccatcagcctccccagctggaaagtcagctccaggcagtagggagtctagaacagagcccgacaggtaggctcccagcagatactcctggaacaaacgcacaagtgaggggtggcgcagcagcactgagggaccgca

SEQ ID NO: 294335 - DNA, 526 bp, Homo sapiens
caaatatagacaagtgggactgcatcaactttaaaagcttctgcatagctaaggagacttaatagaatcaaatggcagtctatcgaatgggagaaggtattttcaaaccacatatttgctaagaggttaatcaaaatacaaaacgagctcctacaacttaatagaagaaaaaaatccatataaagactgattaaataatgggcaaaggactttaatagatatttctccaaagaagacacacaaatgaccaacaggtacgtgaagggatgctcaacatcactaatagagagatgcaaaattacaacgaggtattatctcacaactgttagaatggccatttgaaaaaaatagtgttggtgaggatgtggagaaattggaacccttatgtactgttactaggggtgtaaaatggtgcagctgttttgaaaaacagtatggaagttcctcagaagaattagaaatgctatatgattcaggattcccacttctggatattaaaaaaaaaaaatgaaaccaggatctggaa

SEQ ID NO: 294336 - DNA, 347 bp, Homo sapiens
tcggatacatccgattttactatgatctgaacagggagcaaggcaggggctttgcagggatagagtgagcagggggcgggaggcggcgctggtcgtcagcctgctgttcagccctaggtcagtcagcgtgcttccctctaagatcccccagagcaacaagtgtcgccaggtaaatccagacaccagcgaaacaagccaaagccaaacacgcatcggttctgatttgcctccctgcatgtgtgtctgtctgcacacacgcacaaatcacccttcatcatacaaattactttttttctaatacccttcccttattaaaagccaaaggtgaaaagacgatttacttttat

SEQ ID NO: 294337 - DNA, 405 bp, Homo sapiens
gcccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaagaaatcgaaaaagccctgccgggcgcggtggctcacgcctttaccgtaatcccagcactttgggaggccgcggggcggggtggggcgggggaggatcacgagttcgggagttcgagaccagcctggctaacat

SEQ ID NO: 294338 - DNA, 1869 bp, Homo sapiens
  misc_feature (1869)..(1869): n is a, c, g, or t
gcccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggagggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294339 - DNA, 1828 bp, Homo sapiens
  misc_feature (1828)..(1828): n is a, c, g, or t
gcccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggagggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294340 - DNA, 2090 bp, Homo sapiens
  misc_feature (2090)..(2090): n is a, c, g, or t
aaaaaaaaaaaaaagccgtgggtcaggagccagagccctctgctctagtcttagctgtgccaatgtgactccctgtgtgatttgggggtaaattactgcccctcactgggtctctgtctacccacctgcaaaatgagaggatctttggatgagtctccttaattcatttcctggacaaacttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctggatagcaggctgagtcacttgtttcttgtgccttgagtcagttctctcatcagctctcctcctaggccagtgttattacctccagtaaagatggaaaagttggggttcagagagggctagagacagacagcctgctgtgtcctgtcttttctcctgtgctgtacaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggagggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294341 - DNA, 1854 bp, Homo sapiens
  misc_feature (1854)..(1854): n is a, c, g, or t
aaaaaaaaaaaaaagccgtgggtcaggagccagagccctctgctctagtcttagctgtgccaatgtgactccctgtgtgatttgggggtaaattactgcccctcactgggtctctgtctacccacctgcaaaatgagaggatctttggatgagtctccttaattcatttcctggacaaacttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctggatagcaggctgagtcacttgtttcttgtgccttgagtcagttctctcatcagctctcctcctaggccagtgttattacctccagtaaagatggaaaagttggggttcagagagggctagagacagacagcctgctgtgtcctgtcttttctcctgtgctgtacaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcacttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggagggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294342 - DNA, 1321 bp, Homo sapiens
gcccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggagggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcctagggcccagccacttccctcactggcctagttctagatcgcgagcggccgcc

SEQ ID NO: 294343 - DNA, 893 bp, Homo sapiens
  misc_feature (893)..(893): n is a, c, g, or t
gaggtgtggaggcacactgggggatctggtgccttgaagagaatcaagatctatcctgccacctgttagagctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294344 - DNA, 992 bp, Homo sapiens
  misc_feature (992)..(992): n is a, c, g, or t
gcccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaaaaaaaaaaaaaaaaaaaaaaaaaagggggggcgcgcgcccgcgcggccccggagagaaagagttttaagaaacacacactgcgcggtggggcgcgcgcgggggcccacagggggaaaggggacacacgtggggccaagggggtgtccaaggggaaaccggggccaggacaaagggcggggggatttcaccaaccaaataaaaaaagcgcgccgggggggggaacacgcggaggcggtttcggggaaaaactccgcaaaagggggaggcatcgggaaggcgcccacacaggggggcgttatacacacaggggagggcccaaacggagagcgccaggaactatcaaattatgcccccgggcccggggggggcgn

SEQ ID NO: 294345 - DNA, 294 bp, Homo sapiens
gagccgtggacgccctacagctgagaaggggacccaaggggtcggccgcggccaaggcccctaggaccgccgccccagctcacgctgccgacggcagctatagacattctgcgtgaggtccgggctcctggacttcgcctttcccgagccctggaggtggggagaaaagggtgagcagttcgtgcctgcagcgcagagccccaaacccgcggttttagaaatcgaaaaagccctgccgggcgcggtggctcacgcctttaccgtaatcccagcactttgggaggccgcggggcg

SEQ ID NO: 294346 - DNA, 407 bp, Homo sapiens
cacccagccctcaaaccccgtgccaagcacccgcggactctcacgtcctcttcttccagggcggcgggcgcttctcctgcaccttggcctggcgcctcttctcggcctcctccgcctcccgtttctcctccttggccaccttgtaaggccacttgggtatccgcaggtggccgctgcctttatgctgcccttccgcgccggccttttgggttggaaggtgggcgcgggcaccttgctgaggcggacctgggcaccaccacgctgggccccaagctgctctgctgcaggcactgcaggggcaggaggctggccgtccgcggggcgggggcggcggagccccaggaccccggcagccgggcaggtgggaggccggctcttggggaggcctttgtggagccagcggccgc

SEQ ID NO: 294347 - DNA, 627 bp, Homo sapiens
aggccacgcccaagatggggcggccgctccaaagatggcggcaagccttttgttctcttacctggggttcttggcttcatggattccaaggaatggaactttgggccatgcgatagtcttgctcagttgcccaggctagagtgcagtggtgtgatcatggctcactgcagccttgaactcctgggctcaagttatcctcccacctcagcttccttagttgctgggactacaagtgcaggccatgcctggcttctatggattgtggatttcttatttcatgagctggacacaatttctcatgacattatgcacctggctccaatgctgctattattataatgtactctttatgtatgatattttcacaattaaacaaaatcatttttgatatttttgcttgtgattaaaatagaacttatattgataaaaagaaaagagaaggaaaagaaagagaaagaggagaaaagaacaaggaccaggagcaagagagaaaaagagagaaaggaaagagcgggagagaaagagaaacaagcagccgcgggggcgggggcgtgggggaggggagggggggggataatgagggggggggggcggcgaaaaagaggggtagcgaacgaaggggggagg

SEQ ID NO: 294348 - DNA, 402 bp, Homo sapiens
gtcgaccgctcctgaaccagtcacaggacagggagatacggggctctgattggtcagacccaggatgggtcgctcacctgcacccaatagctgccctgtctgaactctgggctgaaagtggggaatcgcaatctccagagaaaatgagtcctaaagaatgcatgcccaaggtgggcagatcatgaggtcaagagttcaagaccatcctggccaacatcatgaaaccgcgtctactcaagatataaaaaattagctgggcgtggtggcgtgcacctgtaatcccagctactcaggaggctaaggcaggagagtcacttggacctgagaggtggaggttgcagtgagccgagatcgcaccattgtactctagcctgggtgacagggcgagactctgtctaaaaa

SEQ ID NO: 294349 - DNA, 477 bp, Homo sapiens
cagacattgcaatgcagacacataagattagaagcaaaacgcaggaggctggagttacctttcatggaagggtaagcaggaagcaactacaagatcatcatttcaaaacaatatgaaagcagaatgggaaatgccatggcatgctccctcttttcaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaata

SEQ ID NO: 294350 - DNA, 665 bp, Homo sapiens
ttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaata

SEQ ID NO: 294351 - DNA, 265 bp, Homo sapiens
tgaattgaattggtgttttggccaaaaatcagttgaccatctatgcatgagtttatttctggactctattctattccattgatctattgtctctccttaccaagaaccgcattgttttgattactgtggctttatagtaaatactaaagtcaggaggaatacattttccaacttggctcttcttttctaaaattttctagctattctagattgtttgcatttccagataagtcttagaagcagtatgtcaatttctttaaaaata

SEQ ID NO: 294352 - DNA, 2789 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294353 - DNA, 3023 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaaggtaatggctagattcctgtggattactgggtttgttagggaaactggggataaagggaagatgtttatcagtgggaatttcataaagagtctcctatggctcagccatgggagggagatggttccttctgcatgcttctctatctcctgatggctggtgctgagatgacaaatgcatctctctaggaactctgagcctcaccaccctggagactatgttgtttcttttcattagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294354 - DNA, 2807 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaacccttttgtctccttcagttccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294355 - DNA, 2694 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294356 - DNA, 2504 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaaggagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294357 - DNA, 1700 bp, Homo sapiens
tttgtacttacagggtgacattcccaaccaaattaccctagttatgatgaaaaataacttcagcatttcattaaagactctgctagtttaatatgtgacttgtatccccactgcaaagaccttatgtgtgaagaatcacattaattgtaatttttgcttcatgacatagtctcatcatttgccatacatgatagatttctagtcagtcagttttattcttataagcacccattaaccccgagacaataacctactatatctatgtggcttctcccattctcttcctctacctcactccatctgataaaaaaccattctaaatctcatgttcattattcccatgctctcctatttctatcatattaatgtatctacatgttttccttaaatatgtttttatattagttttaactataagttaaagaccatattgttgtagataaatttttttagtactttctcttcatgttgtatttctaagattcatccatattgttgcgtgttgctatagttcatttgtttttattgctgtttagtatttacttgtgtaaaatatctggcttaatgttttcctagctatcaccatcaaaaactctttccacagtgtgttgaatttttaatatgacaaaaatgaaaatgtaccaacaattttcagtgacttcacctccattctgaaatcctgatgtttccaaatatctctgaacacctcaagtcctagggacaactgagattatattaacattaatctctgaatgttgccaattctaggccttcacttggttcatgtaggaacaccaagtccctttcaaagcaccacatcttcctctaatcaatatttcttggagtccctagggaatgtcttacatgcattcaaacaatcaccatttctggagatacactacagggtcaccataaactctgctacccttaggttccatcactatggaagctgagtttcaccagaaggcacttttgtcctccattacgaccagcaaagccagctaagccacagctgctggcctcaaaaaatgtgatgatcaatccacactgctcccactggcctctgttacccttatcctggcctttgagtgcagggcatgatgtcctgcccgtactgagatgctgatctctgccagttcatgttcatattggcattaaaattttaaggtcccttgaagagggaggaggcaaatgtctctgtcttctatgtgatacattctgctgtttttttctctatggtgaaaatatgtaaaccggttttgggtaccaaccaccaggctgtatatggaggctctcctcctttctaaccctgctgctgatttggaattaccttgccaagcccctttgtgccttatagtgaactttctctaagggacctgtcatctcttatcattgtttatccattttctagattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294358 - DNA, 2867 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcagggtatgtgaggctgagcaaaaggtctgcaaatctcccctgtgcctgatctgtgtgttccccaggaagagagcaggcagcctctgagcaagcactgtgttattttcacagtggagacacgtggcaaggcaggagggccctcagctcctagggctgtcgaatagaggaggagagagaaatggtctagccagggttacaagggcacaatcatgaccatttgatccaagtgtgatcgaaagctgttaatgtgctctctgtataaacaatttgctccaaatattttgtttcccttttttgtgtggctggtagtggcattgctgatgttttggtgtatatgctgtatccttgctaccatattgggaacagccaa

SEQ ID NO: 294359 - DNA, 2950 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaagggctccacatggctgggaaggcctcaggaaacttacagtcatggaagaagatgtaagaaaagcaaagaccttcacacggcagcaggaaacagcgagttagcaagagctgggaagactgccttacaaaaccatcaaatcttgtgagaactcactcactatcacgagaacagcatgggagaaactgcccgcataatccaatcacctcccaacaggtccctcccttgacacatgggaattatggggattacaattcaagatgagacttgagtttgagagcaaaactatatcaatggctttgcatcacataatttattacaggtgtgttctggaatagtttctataaattgatccattcttgt

SEQ ID NO: 294360 - DNA, 3086 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagaatccaacagaggaaacagtcaagagatcaagcaaatcaagaagattggcttggagtactttttctatgtgggtttggaagaatccagcagaggaaacagcaagagatcaagcaaatcaagaagattggtttggaatgcagtgtgcgtacgttgtaagttggaatatattgcccacagtttaatacttttctttgctactcctacccaacagctaattgtccaatgatgcatcaagagcatgaggtgagtcacatttcttggctttctttcctctctggccttcctctcctgtatttaggtacttaccttttgtgtttttttctaccaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294361 - DNA, 2956 bp, Homo sapiens
agactgcagctgaggtggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagaatccaacagaggaaacagtcaagagatcaagcaaatcaagaagattggcttggagtactttttctatgtgggtttggaagaatccagcagaggaaacagcaagagatcaagcaaatcaagaagattggtttggaatgcagtgtgcgtacgttgtaagttggaatatattgcccacagtttaatacttttctttgctactcctacccaacagctaattgtccaatgatgcatcaagagcatgaggtgagtcacatttcttggctttctttcctctctggccttcctctcctgtatttaggtacttaccttttgtgtttttttctaccaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcaggattctgaacccaagaaagaacaaagttcaagattttccatgtctttgtaacacttagccctgtgcaaatcagagtatgtgagtggaagaaggggtgagtcctaactgtacatctcggatataacaaatgtgcaaattctgattgattgccctgtaaaatgaattattctcatgcagtgctctacttgacttttatctttgaattcacaactaaaaacccatagcccagaaatctaaaaaaagtaattttagtggagcctttgaaaataaaagaccattggaaaaagtac

SEQ ID NO: 294362 - DNA, 2109 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294363 - DNA, 1014 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggtaaaaaacagaacaacgaagaccagccaaacccgaacacgacgaacaaagcagataaaactgaatgcagcacaggcatcacaacaacagacggggcgggggcagaaaaaaacaccgaggggacgcaccaataacaacacccgctgtttcgacaaggggcccccctgggggctattaaaacgagccacggcggcgaaacacgcgggaggaaaacgacagggtctgggaagacaccctggcgcggagaagggcacaccgagaagtgaggggcgccataaaacgggctggtggacgcg

SEQ ID NO: 294364 - DNA, 554 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtatctcacttctcccatcagcactatcaacagtcatggagggcttaccatctttgggacattcatttaggatctgaagataaaaaggctgcttgttagaggcgttggctttcaaagaaaagatgaagttgatcttaccggttcaagctaaaagttaattacctgcagaaataagcactttgaaatagaccataattaaggctcattgcccattgttgattttcttctattagacgagctgtgtttttctcccaaagctttatgtatctttttattatttgtatttatgaccaggcatgtgccacactccaggttgtgaattaaactgatgtgacgaagaagcggggtttttg

SEQ ID NO: 294365 - DNA, 913 bp, Homo sapiens
gacggatcttcagatgagactaatgtagaggggtccacatcaggtaagttcctaaaacgagaagctgccttatccctctgttgcacggctcagggtcccatcataaagtctagagtttgctaagctgaaatgtcctctgcactcaaggacaaacggagttaagtgcaattgtttacagtccaagaaagctcgctggctggttttttcctggatggctgaggtcacttctcagtgacctacaagtcacgtccacgtttctattctgctcggtgcgctaacctaaagaagaaacccaacgtttacttgactaacttgataatcaagcctcccccgccgggacacttaatcttttaggtaccttcagcctactagaccctggtccgaggcacgggttcagtcctttttttttccgtattctatttttccctcacagttaaaaagtacttcacagttaaaggcggcattttagaactgcagcgtgaagccagagcgtttgtcttagtgaccggccaactttcgggctcactttcgagctctgtggtacaccaccattctcagattcgacgtctaactcaggagacgctgaccttcgaatcgaagggaattcggagagtcttggtataagccggctggttcaccgctgttaatgccagccgagagggaaaaaaaaaattcaaccaaccaaaacaaaagttaaaagcgccactctttctattctttgctgtctggcaatctcttaatggtggcgtctagcaaactgcaaatcaagctccagccggagtccgcagggcagggagcgccgggtgcggcccagtccccgcgcccagcgcgttggcgcgcacaccccgtttctgcagactcaggttttctggccccgcctctttcgggcccagctgatctccaccgcccgtta

SEQ ID NO: 294366 - DNA, 606 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacagatgacatctttatatttggcttcaaagaaagaagacccaatttaaaggaaataaaattgagacatacctctcctgttgctagagcaacaaaattttccactgtcttgggcacaacttttccaaagaggccaatcacaattctgccaacatctttgtctccaatcctcacatcaaagaagacctgtgtgcagttgaaaggcaaagtggaaggttata

SEQ ID NO: 294367 - DNA, 385 bp, Homo sapiens
agaaaacaactcttcctgccatccaaggggcaactagtacattctggaccatgggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggta

SEQ ID NO: 294368 - DNA, 2129 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaacaaaaaaaacacacaaacaaag

SEQ ID NO: 294369 - DNA, 2050 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccgcatcacccgttcggggttcctctagagcc

SEQ ID NO: 294370 - DNA, 1768 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatacta

SEQ ID NO: 294371 - DNA, 3412 bp, Homo sapiens
  misc_feature (1697)..(1697): n is a, c, g, or t
aaattattgttttttattgggctctaaatatacatgtgtaaggcctatcacacgctttcaaagatatatttcatgaaaaaccattacttcatgttggggaaaggcatgcactaaaaaaatcaagtgtcatcaaccagaaataactggatattcatgtattagagattttctaagatatagtttgtgtgttcattcgcttgtctccccaatttttaaaacagcctataaggtagatactattatgaaatccatttcacagttgaggaaagagagagacagagatgttcaataactcacctaaggtcacacaggtattaagtggtcgatccaggaaacagaggcctctcaataaatatatgttgaggtaaacttgtcaccacattctatcacttacttgacttcccctttggcaagtctcacgggtgcctcaaacacaagttccagacagagttgatgatcttctattttactcctcttctgggtcttctcccaccaccctctgattatgcaagccagaaacccaggaggcatccttgacttcaccccttccctcactagccacatctaacctgtcacttggtcccgtccttcatttctctagaattcctccatggttctccatcctcaacctcgtttgggctgccaccattgccctctcgaactactgcagtagtctccaaactgatcttgtgtctgctttgaacttctccagtccattctccagctggcagccagaatcatctttttcaaaacacagttcaactctgtcccactctgcttaaactccctcagtagcttcccattgagtttcagataaagcccaaactcctatccattcttcccaggtgtgatggggcaccccgtgccctccagcctcctcattcccacttttctcactatgttggctttcgtttaggtctctgaaccctccaggctccctctggccacagacttgccacctggctagctccctctgcctacccctagcctctgagagcctttctgcctcctctgatgaggcccaatcccctagtaaatgattttatttacacagtagacaatagaggctagatgcatattttttttcttaaaatattggactacttttattttcttacataataatgatatttatttaaagtgctttaggatagttcctggatatcattatgtacagattaaagtttaaaaattaaacttctgaaccatgagatagattggttcccattcaagtaatccattcacattttacctactgtaatgactggaatgtgctgtaacatactttgcacccctggcctcccttcctgtctcctataataatggagctgtgttttcaagtttggcaggatggcttctgttggaaatttgcccttttaagttaggaagactgacccccatcttactgctctctttcgaagctagtctaatggaacaagtagactcaggacaacttggactaaatgcactgtaaaccacaatggaaaaactgcagtgaggtattcccagtagaaatcttggaattccttcaagtatattgagattttgttagaaattgaattgccagtgtaatccatcttccttttgagaaaacattcagataaagagctgaggcctagcagcattaactgttagaacatcccttaaatcaataagctacaaatctggccgcacattcctgccgcgcctggtggtgngctcaagtggctttaggctgaagcagcatgactgatagcacatcctcaaccaggcacatgcctggcgatgcagattcctgtgtttaccgtaagcattgccttgttccattctacagaatgcaattatattttgtttcacataagaaaagcagtttttcttttttttttctttttttttctttttttcagattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294372 - DNA, 1978 bp, Homo sapiens
  misc_feature (21)..(21): n is a, c, g, or t
taggcaggtacgaggccgggngatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294373 - DNA, 2072 bp, Homo sapiens
  misc_feature (21)..(21): n is a, c, g, or t
taggcaggtacgaggccgggngatcccgtcctttcgctatgaagagagcgacctggagcggggatacacggtgagggtcttgcagtgttgcccaggcaggccctgaactcctggtctcaagcgatcctaccgcttcagcctcccaagatgctggcattacagccgtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294374 - DNA, 2146 bp, Homo sapiens
tgattctggaaatcgctttttcaaatggaagacttacatatcaggtgttttcttccattcattagcacttctatcttaaacacctgatatgtaagtcttccatatcaggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggagaaagtaaacacatacacacacatggatggagagagggacagagggatggacggatgaatgcattggtagatgggaaaacgcttagagagtgatacgctatttcgattctatctcactatattctaaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294375 - DNA, 2239 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggagaaagtaaacacatacacacacatggatggagagagggacagagggatggacggatgaatgcattggtagatgggaaaacgcttagagagtgatacgctatttcgattctatctcactatattctaaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294376 - DNA, 1184 bp, Homo sapiens
tcccctagttttagaagttcaatagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaaca

SEQ ID NO: 294377 - DNA, 721 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggta

SEQ ID NO: 294378 - DNA, 851 bp, Homo sapiens
cagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggagaaagtaaacacatacacacacatggatggagagagggacagagggatggacggatgaatgcattggtagatgggaaaacgcttagagagtgatacgctatttcgattctatctcactatattctaaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggta

SEQ ID NO: 294379 - DNA, 648 bp, Homo sapiens
ttctttgctgtctggcaatctcttaatggtggcgtctagcaaactgcaaatcaagctccagccggagtccgcagggcagggagcgccgggtgcggcccagtccccgcgcccagcgcgttggcgcgcacaccccgtttctgcagactcaggttttctggccccgcctctttcgggcccagctgatctccaccgcccgttaggcccgaaacccaggcgcctggagccctgcgccctctgcttccggcccccggcacgcccagggcgcgggagcggccgggtcagcccgcagacctgagtccggcccgcagcctcggggccccgcgagcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtaggcgcgggccgcgggcggacagggccccgcgagccaggcctgcggctgctgcgcccaggaaacacccttggccgccgccgccttggcgcagggggtcccctcgttttctctcccctcccccggcccagaggaagggctgcgcccttggcgcggttgtc

SEQ ID NO: 294380 - DNA, 168 bp, Homo sapiens
cttaagaaatgtataaaaactccagaaatcccttctaaacatgttaggaactgggtccccaaagtcttggaacagcgacgacaaggcttggaaacatacttacaggtaagatatgtttagatcctcattttatataacataaataatcatatgtcttaccactttttc

SEQ ID NO: 294381 - DNA, 1688 bp, Homo sapiens
  misc_feature (162)..(162): n is a, c, g, or t
aatacttttgatcacttccatttgcctgcaaagccagaaacttctctcaagaagattatagctgagtatgtaaaacaaaatatatgtacaactgtaataccaacaagcacagtggtaagttataacaagatatacgaagtaatagaaattaagaagtgagantatcttcaggcgaaggcaactgggaagctggagctcaaagtttaaggctgtgttaaaacacaacctaaagttcccagtagaagcttgctatagacttttggtggctctgagaattcccctggtcacctcagtgtgaggggtgggtgattcttaacctctggtgggttttgttgcagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggg

SEQ ID NO: 294382 - DNA, 2028 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggg

SEQ ID NO: 294383 - DNA, 1030 bp, Homo sapiens
ttatgaggtgagtctagaggatcccagtgctacgctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggg

SEQ ID NO: 294384 - DNA, 2900 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggcctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaacaggagggggatggggaggagggacatgagcactccgctggggccgggacggggaatgaggaggaagaaggccctctcttcccctacccgggccctccaggaccttctccctgagtcggctgtagggaggactccgaggaagctcggcgcggtgcgctgggcctcctggcgccgggaggagcgcgcgaggcaggcggggcgggcgcgtccggggcggggcgctggacttcgtgggtggtccccgcccccgcggcgcctaggcccgcgcctgcgtcccccaacccggaggagatggggggctgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaaa

SEQ ID NO: 294385 - DNA, 2816 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggcctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaacaggagggggatggggaggagggacatgagcactccgctggggccgggacggggaatgaggaggaagaaggccctctcttcccctacccgggccctccaggaccttctccctgagtcggctgtagggaggactccgaggaagctcggcgcggtgcgctgggcctcctggcgccgggaggagcgcctgcgtcccccaacccggaggagatggggggctgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaaa

SEQ ID NO: 294386 - DNA, 1881 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaaa

SEQ ID NO: 294387 - DNA, 1703 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggg

SEQ ID NO: 294388 - DNA, 2319 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggcctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaacaggagggggatggggaggagggacatgagcactccgctggggccgggacggggaatgaggaggaagaaggccctctcttcccctacccgggccctccaggaccttctccctgagtcggctgtagggaggactccgaggaagctcggcgcggtgcgctgggcctcctggcgccgggaggagcgcgcgaggcaggcggggcgggcgcgtccggggcggggcgctggacttcgtgggtggtccccgcccccgcggcgcctaggcccgcgcctgcgtcccccaacccggaggagatggggggctgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaaa

SEQ ID NO: 294389 - DNA, 1117 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccaccaggacagcagcaccaccagacagcagcaccaccagacagcagcacaccatgacacagcaccac

SEQ ID NO: 294390 - DNA, 968 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggg

SEQ ID NO: 294391 - DNA, 1563 bp, Homo sapiens
cccagtgtctactccacaaacaggagcagaggaactctcaaggggtgagcaccaggagactgggatccctgggggctgtcttagagcttactcactaccacactcattcataataaggcctgtcaaacaagggagacttggtcatacacctgagttatataaatcctcatccagtctccctatggttgacaaggtgtcttgctcataagcgtcagtacctggtgtcaggtgctctcatataatcaatcactgtttgtggaggtagcactggtgctgctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggcctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaacaggagggggatggggaggagggacatgagcactccgctggggccgggacggggaatgaggaggaagaaggccctctcttcccctacccgggccctccaggaccttctccctgagtcggctgtagggaggactccgaggaagctcggcgcggtgcgctgggcctcctggcgccgggaggagcgcgcgaggcaggcggggcgggcgcgtccggggcggggcgctggacttcgtgggtggtccccgcccccgcggcgcctaggcccgcgcctgcgtcccccaacccggaggagatggggggctgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaaa

SEQ ID NO: 294392 - DNA, 869 bp, Homo sapiens
tcgcgctgcccaccgcggctcagcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagaaaaggtatgggtcagccagtggtctgggggactgtgggtaaaagtgaatgtcatcccaagagatgcctcaccctctatgcctgtggggctcttcattacctgccaggtaatggcttctgggaaggggtttggcaaaaaagcacacgtagcagagtgctttaaatgtacttttaaagacacagaacagtat

SEQ ID NO: 294393 - DNA, 1382 bp, Homo sapiens
cattatgctaacagcataaacatgcagggggtgggagcagggtcacaaaagtgagtgttgtcaattctacttggaatgaaaggttgaaataatttaaacagtacgggaaatgcagagcaattttctcctctggtgacaatatagtgtccaacacttggaagtgatttttaagaatgtttatttaaattaaaaggatggatttccaaggaaaaaaaataaggaaaaggaaagaaaaaactgaacagaaaacgcaaaagtatcagtttggtcactaacctttgcaaggatacctttttattttctttaagattcctgttgtttatacacagattttaagtttactcctactgctgacccaagtgaaattccttctccagtcacagtgtcaacctctaccccccaactgcaacgagagttttgaggggcatcaatcacaccgagaagtcacagcccctcaaccactgaggtgtgggggggtagggatctgcatttcttcatatcaaccccacactatagggcacctaaatgggtgggcggtgggggagaccgactcacttgagtttcttgaaggcttcctggcctccagccacgtaattgcccccgctctggatctggtctagcttccggattcggtggccagtccgcggggtgtagatgttcctgacggccccaaagggtgcctgaacgccgccggtcacctccttcaggaagacttcgaagctggacaccttcttctcatggatgacgacgcggcgccccgcgtagaaggggtccccgttgcggtacacaagcacgctcttcacgacgggctgagacaggtggctggacctggcgctgctgccgctcatcttccccgctggccgccgcctcagctcgctgcttcgcgtcgggaggcacctccgctgtcccagcggcctcaccgcacccagggcgcgggatcgcctcctgaaacgaacgagaaactgacgaatccacaggtgaaagagaagtaacggccgtgcgcctaggcgtccacccagaggagacactaggagcttgcaggactcggagtagacgctcaagtttttcaccgtggcgtgcacagccaatcaggacccgcagtgcgcgcaccacaccaggttcacctgctacgggcagaatcaaggtggacagcttctgagcaggagccggaaacgcgcggggccttcaaacaggcacgcctagtgagggcaggagagaggaggacgcacacacacacacacacacaaatatggtgaaacccaatttcttacatcatatctgtgctaccctttccaaacagcctaatttttcttttctctcttcttgcacctttacccctcaatctcctgcttcctcccaaattaaagcaattaagttcctgg

SEQ ID NO: 294394 - DNA, 3314 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactctaaaaaaaaac

SEQ ID NO: 294395 - DNA, 2724 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgat

SEQ ID NO: 294396 - DNA, 1019 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacat

SEQ ID NO: 294397 - DNA, 1080 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagacggggtttcaccatgttgaccaggccattcagccgacttgtagcagtgcaacagattgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatcatttcaaggttgtatgtgtaggatacat

SEQ ID NO: 294398 - DNA, 525 bp, Homo sapiens
agaagtgctgcatgacaagagtaccaaagaaggaagcagagtgttagtgagtttgatgagcatgctctggttgtatgggatcatttaagaagagtgcattctacaaaagcatcagtgttggaatagggcagttaaagcccaaaggaatcctgaatcatcttgggagaagtaacttactgtatggttattcccacagtgtgagtgtcgtcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacaggtgggaggaaaagaatagccttttgaaagagatactgggttctctatagtctcctagtatgctaatagcttgttagctatccccacgttttttcg

SEQ ID NO: 294399 - DNA, 563 bp, Homo sapiens
gacttgagcattttcagataccaacagacagtacactgcagacatggtgatctttgaatcactgggatacggagatgaataagatcaaacccatgtcctcaaagggtttaatctttcctttacacctacctccatttatcaccacttcaccgcttcctccaaaaatgtggggtattttgctcttaattactgaaaagtgaactgaaggacctctgctgctcaaacatcacaaaataaaagttgtgtgtttcaatgttttgtgttgccaaaatctttttaaaatgtacctacatggtgttttattctagaagttcagttatattcagtatattctgctttacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggtatgtgagccttctagatttctgaagaaaataaaaattcaaaccccaaaatgt

SEQ ID NO: 294400 - DNA, 184 bp, Homo sapiens
gcggccgcctactactactactactactactgctcgaattcaagcttctaacgatgtacggggacatgtgtatgtacatatatattttaaaagactgtttactgcagttgctcaggaactgcttttgattcacattaagctgctttcagaaattaaaaaaacactttttaaagggtgcattgat

SEQ ID NO: 294401 - DNA, 3074 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctccta

SEQ ID NO: 294402 - DNA, 2517 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgat

SEQ ID NO: 294403 - DNA, 3281 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctccta

SEQ ID NO: 294404 - DNA, 2675 bp, Homo sapiens
agaagtgctgcatgacaagagtaccaaagaaggaagcagagtgttagtgagtttgatgagcatgctctggttgtatgggatcatttaagaagagtgcattctacaaaagcatcagtgttggaatagggcagttaaagcccaaaggaatcctgaatcatcttgggagaagtaacttactgtatggttattcccacagtgtgagtgtcgtcatctaactgccctcatgcttctttttaggccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctccta

SEQ ID NO: 294405 - DNA, 1638 bp, Homo sapiens
aagctcactagcagcattcgtaatggtgcgcggacactagcccagataatgtgaacttgttcatagcatgtatcctaggagatcctgttcatgacttagctgctaggtatctcaccaagtaaaaaacgtccccggctgtaaaacgaatgtcctgaacccttccaaatgcagttcggtgttcttaaggggcatcttctcaatcagagagtcctaagcgaagtgtcgactatgctcaagtgacgtccccgcacttgttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctccta

SEQ ID NO: 294406 - DNA, 2450 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggtatgggcaaaaaaatatgaaccatttggggctcaagtttctccaaatactttatgtgactgcaagtactgtatacgcttatttcctgtgactcagttcttctaactaagatgttaagcatttggcttaaagtgtatagcattacaaagagtatttccccagctttggcttgccagccaactttccattgactctagcctgttagccatttttattgttttttgtttgtttgtttgtttgttttcctcacatgtacacatacatacagattgttcttatatgtgattttgttctctgggaataaaatcttcattcaacagaggcaatatgacagaaaaaccgaagtttcatgtatatgatttttcaaagaaagtgaattggccctcatgttaaacctagcatttcagagctgaaagtgtcttctcattaaatattgaagaaatcatttgagggtgtggagaaggatggacagaattagctgcttgtgtatttattcttctcctgcaactttgccacgctattttgtacctcccttcctaattatgataaagctttcttagagagcagtcaggcaatgtgtattaaatgtttaaagctttacacccttagttctacttgtggacatttatttcttaagaaagatgtatactaagatttagatagaaatattcattacagtatcataataaagacagtagcaaggattctgttatctgtgttgcattaatacaatagagattgatgcaactgttcattattttgaaagcattaatgataatattgcatcaaagagttcactgaacagattgtacagtacagttttacacacaaaaaaaatagtttgtgagctttaaaagggccttcaaatgaatatgctaaacggttatctttcaataaagagagtatgggtaagtc

SEQ ID NO: 294407 - DNA, 1458 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagaggcaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctccta

SEQ ID NO: 294408 - DNA, 1049 bp, Homo sapiens
tccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggtatgtgagccttctagatttctgaagaaaataaaaattcaaaccccaaaatgt

SEQ ID NO: 294409 - DNA, 420 bp, Homo sapiens
gcggccgcctactactactactactactactgctcgaattcaagcttctaacgatgtacggggacatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactctaaaaaaaaac

SEQ ID NO: 294410 - DNA, 309 bp, Homo sapiens
atccttttctgtttaaaatttaggcttctcaggaagcaaaaatgatcaaacccatgacaataaatgtggatctttctgctgttgctttcttattgcccttatgggaattaaattattttattgaaatctctttacttatcgtttcttgccttgaggggaacttagtactgactgctaaaatgttgcaaagacaaatgttgagcatctttactgtgtgtgattagtaatttcttctgtgctaacctgcaggtattatcatggtccaactccaatccagtcactacagtatgcaacaagtcaggacattat

SEQ ID NO: 294411 - DNA, 548 bp, Homo sapiens
gtaactgtttatctctgatagacactggtatttaacttgccaccctctagacattataagtgttaatttctgagacagataagacatgctgaactttttattttgttgattttctaggcctaaaaacaatggtttcattaggagtgaaaaacccactactagatttaacagctttggaagataaaccattagatgaggtaagaagcaataaaagaagttttgagagaaaagagtcttttcctagtcttcaacattgtcttaagcgtagtagacctattccacttgtgagaatgtcaaataagcaaaatactgttacttgaagtgatttatcggaagtgctttgaaatagcgttgtttgccattaaaattgcctagaagaaatgaaattcctgtgtgagttgctaaaaccttttaaaaataaatttctagctccctcatccgcagttctctagtaataataaaggcttaatgtgatgagttcagctttatgctctagctaacatttaatctaaagaaatatggataaattaataaataaggaagataac

SEQ ID NO: 294412 - DNA, 333 bp, Homo sapiens
ttttgcatttcaacatgcctggttcaaactagctaaaaaacgtataatttactaacaccaaacaacaaaaacaaaggctaaagcaaaacaaaacctagagtttcccaataaggtttgaataataagttattttgcaatgaatattaaagcaatctgtaccttttaaaattcaaagttacttctttcattgaagaatgtagcccaagagatggctggcaggttcagtcactttctaatgcaaaaactacttgataaggaatctttttcacagcgattccctgatgcatctaatgtgtcaaaaataattaggttttggcagatttatcattgcag

SEQ ID NO: 294413 - DNA, 760 bp, Homo sapiens
tcaaagacaacttctaaacagaacaaagcattcctccataagttaaaaaaaaaaaaaagtgatcagtactggttagagagataatttatgaattattttaacaaagacacaagtgttcttactatttttccacccagggaacgggtttggctttcttgttctctccgctacttcccgcactggcagctactcctcgatccttggtcagcgggggtttagtactgatggatgtacctttaagaaatgcttgcatggtacttcaccctgtctctactaaaaatacaaaaaattagccaggtgtggtggtgggcacctgtaatccctactatttgggaggctgaggcaggataatcacctgaacccaggaggtggaggttgcagtgagtcgagaccatgccactgcacgccagcctgggcaacagagtgagactccgtctcaaaaatagtaataataataataatactttccacctattgtaatgagaagaaggaggaacagattacatatttggatttaagtagaactcctgacctagtatttatagccagtttacagaaacttttgttttcttcacttctgtatcccagcccctaaaatggaagcctctgcttgtagagatctcagtttatctacaaaataagggagttaaactagattattctcaggtaactttagttccagggttctatgacttatataagtgggtgattttttttcaaagacaacttctaaacagaacaaagcattcctccataagtt

SEQ ID NO: 294414 - DNA, 638 bp, Homo sapiens
cgcgggccggggcgccgagcagagcgacgccgacttttggagcagtttgcgcctgcgcggaacgcgtggccggcttccggaatcctaccgggacttttccggtagcgaagcccgcgcctgtgccaaggcttgcgagcagaatgccttcgcgatggacgcccgcattccacccccttgaccgctgggacccctagtggcgggtgggtggagcgcgctccatttacctgctggttacctcgtgaggcgcctcagattcttctggagctggagatgaactcggacctcaaggcccagctcagggaactgattattacagcagcgagggaaactgaagttggtggtggtgagaaagttatcatgggcaggtgcagcagctcacgcctggaatcccagcactgtggggagctgaggcgggaagatcacgaggtcaggagctcaagaccagcgtggccaacatggtgaaaccccgtctctactaaaaatacaaaaattagctgggtgtggtggcacgtgcctgtaatcccagctactcagggggccgaagcaggagaatcgcttgaacccgggaggcagaggctgcagtgagccaagattgcgccactgcactccagcctgggcaacaaagcgagactccatct

SEQ ID NO: 294415 - DNA, 923 bp, Homo sapiens
gaggttgcagtcagctgagatggcaccactgtaccccagcctgggcgacaagacagagacttctctgggctgccagaggctccggaagccgggtgcctcaggccgtggcagttccgtcactctccaacgcctcccccacagacttctttttgctaaatggtatcaagattttctcgttgttgtcagcaagagagttggttttctaacatctcatcgaccatggctggaggtcaaatcgatgttttaaacttgctggaaataaacggttcctttcttgcatggctcgatgagcaataaggttcctctgtgtcattttgtttacgatttttaggattgctttttaaagccggacacggcggctgatggctgtaatcccagcactttaggaggccgaggcaggaggatcacttgagataaggagttcaggaccagcatgggcaacacagcgagaccccatctctatagaaaacacaaaaatgaggctgggggtgctcatacacgcactgagggttgaccctggtgttcttgccttctcagattcttctggagctggagatgaactcggacctcaaggcccagctcagggaactgattattacagcagcgagggaaactgaagttggtggtggtgagaaagttatcatgggcaggtgcagcagctcacgcctggaatcccagcactgtggggagctgaggcgggaagatcacgaggtcaggagctcaagaccagcgtggccaacatggtgaaaccccgtctctactaaaaatacaaaaattagctgggtgtggtggcacgtgcctgtaatcccagctactcagggggccgaagcaggagaatcgcttgaacccgggaggcagaggctgcagtgagccaagattgcgccactgcactccagcctgggcaacaaagcgagactccatct

SEQ ID NO: 294416 - DNA, 701 bp, Homo sapiens
ttttttgaaccactgctaacaatcactaatgttcactaaaacactaggcttcaggagcatttggaaataattcctgaccgcacaaagaaacatgctggtgagagacagtgaccaagcccaggagaccaccatgagttccagaaaaagtgagagagagcggccacttttcctgtctcggagatacctcctactcaggacgcaggaagcatggggcagggcagcgccatggacaaggcgactcggtgcagggcctgcgggacctgcaggtgagaggaagcacaagctccagctcctcagctgtggaacgctgcgtgcgcggtgcacagctaccagctcggatgggtatttgagaatttaccgcactgacttggaccagacggaaagcagagaagagggagagctacacctgactgtccaccatccccgccagccccaacgtcggcttttcacttcatgtttggggacaattacacctcctcatgacagatcagaagtttcagaaaaaaggtccgctgatttccgcaacagggtatgaggtggccagctgctgatgccagctgcatggactcctatacttgctggtaacataacctcattcctttgtatttgccaccaaaaagtctccagtctttttttttttttttttttttgggggatcccttaaaattcccccggggggtttaaaatttggaaagggcccg

SEQ ID NO: 294417 - DNA, 1001 bp, Homo sapiens
ttttttgaaccactgctaacaatcactaatgttcactaaaacactaggcttcaggagcatttggaaataattcctgaccgcacaaagaaacatgctggtgagagacagtgaccaagcccaggagaccaccatgagttccagaaaaagtgagagagagcggccacttttcctgtctcggagatacctcctactcaggacgcaggaagcatggggcagggcagcgccatggacaaggcgactcggtgcagggcctgcgggacctgcaggtgagaggaagcacaagctccagctcctcagctgtggaacgctgcgtgcgcggtgcacagctaccagctcggatgggtatttgagaatttaccgcactgacttggaccagacggaaagcagagaagagggagagctacacctgactgtccaccatccccgccagccccaacgtcggcttttcacttcatgtttggggacaattacacctcctcatgacagatcagaagtttcagaaaaaaggtccgctgatttccgcaacagggtatgaggtggccagctgctgatgccagctgcatggactcctatacttgctggtaacataacctcattcctttgtatttgccaccaaaaagtctccagtctttttttttttttttttttttttgagacggagtctcactctgtagcccaagctggagtgcagtggcacaatctcgggaaaaataaaatacataggcagggcgcggtggctcacgcctggaatcccagcactgtggggagctgaggcgggaagatcacgaggtcaggagctcaagaccagcgtggccaacatggtgaaaccccgtctctactaaaaatacaaaaattagctgggtgtggtggcacgtgcctgtaatcccagctactcagggggccgaagcaggagaatcgcttgaacccgggaggcagaggctgcagtgagccaagattgcgccactgcactccagcctgggcaacaaagcgagactccatct

SEQ ID NO: 294418 - DNA, 967 bp, Homo sapiens
ttttttgaaccactgctaacaatcactaatgttcactaaaacactaggcttcaggagcatttggaaataattcctgaccgcacaaagaaacatgctggtgagagacagtgaccaagcccaggagaccaccatgagttccagaaaaagtgagagagagcggccacttttcctgtctcggagatacctcctactcaggacgcaggaagcatggggcagggcagcgccatggacaaggcgactcggtgcagggcctgcgggacctgcaggtgagaggaagcacaagctccagctcctcagctgtggaacgctgcgtgcgcggtgcacagctaccagctcggatgggtatttgagaatttaccgcactgacttggaccagacggaaagcagagaagagggagagctacacctgactgtccaccatccccgccagccccaacgtcggcttttcacttcatgtttggggacaattacacctcctcatgacagatcagaagtttcagaaaaaaggtccgctgatttccgcaacagggtatgaggtggccagctgctgatgccagctgcatggactcctatacttgctgattcttctggagctggagatgaactcggacctcaaggcccagctcagggaactgattattacagcagcgagggaaactgaagttggtggtggtgagaaagttatcatgggcaggtgcagcagctcacgcctggaatcccagcactgtggggagctgaggcgggaagatcacgaggtcaggagctcaagaccagcgtggccaacatggtgaaaccccgtctctactaaaaatacaaaaattagctgggtgtggtggcacgtgcctgtaatcccagctactcagggggccgaagcaggagaatcgcttgaacccgggaggcagaggctgcagtgagccaagattgcgccactgcactccagcctgggcaacaaagcgagactccatct

SEQ ID NO: 294419 - DNA, 1700 bp, Homo sapiens
cccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccatggagcactctgagatctcatcgtggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccacgcactgacgcacgatgtagggcaccttggacctctctctcctgcgggaggagggaatgttctcagtgtcctaacagccctgcttgggccataacacaggagacctgctccctatctgcacacccggaggtggggtgaggacggtgacgaaggtacccaggtctggggctgcacacagagccttctgcatgcctgtcctccctctgcaagctctgtcctcattgcatgtactttctcaggaacctttcaagcggccagaaccctgcgaatcacacatgacctttgcgggaaggtcaggaggcctgtctaagtcaagtcagcacgggaagggcatctgacagattccaggcctggggttagcagcctgtgaccccggctgggaggtcagagccggtgttggtcctgccacccacgtgctgtgtgagaggagaatccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatg

SEQ ID NO: 294420 - DNA, 815 bp, Homo sapiens
  misc_feature (4)..(4): n is a, c, g, or t
  misc_feature (8)..(8): n is a, c, g, or t
  misc_feature (11)..(11): n is a, c, g, or t
  misc_feature (35)..(35): n is a, c, g, or t
ttantctnttntaggaccgccgccggttcggaatncccgggtgcgacccacgcgtccggctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatg

SEQ ID NO: 294421 - DNA, 468 bp, Homo sapiens
cactcataggtgggaactgaacaatgagaacacttggacacaggaaggggaacatcacacaccagggcctgttgtggggtgggaagagtggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatg

SEQ ID NO: 294422 - DNA, 2427 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgaaaaaaaaaaaaaaaaaaaaaaaaaaaaaaaaaaaaaaaaaaaaaaaacaaagacaaaaaaagaaaaaaaaaaaacaaaaagacaaagacagagatgaacactagaaacagaaaagaaaaaaaaacaaaacacgggcggaggataagagaagaatcaataacaagggaggaacacaccacagacaaaccccacgcacacaatacaaacgaagtaagggacgtgtctctatgcagcacatacataatacgcgcctccgtggcgacaagacacaaacagcaaccataacgacaaacaactaaaacaccaccacccaccacattaaccaaacaaccaactactatttatactcctactaaacactcacacctcaccccacccatcaaccacacaaaaacaaaacaacacaaaacacgaacatcacctatcaccactaatcatatgagcagccacacagatggagcagacgccctccgtgtggcggagaagagagcagagagagtaggccgggcgccgcgcgcgcgccgagcaaacaaaaactgggcgggcaggggacgaagagagaccgagacaagggagcagcaagagacggcgacgacgacccaaagagcgggcagcacgcgagggccgcagcgctcggtccgagggggaaggcgcgaggagcgaatcagcgagggagccccgaagcgggacagagagaggaggacggagcggcgagacaggcgcggagagggccggaagggcagcaagtgcgcggcggcgcacacagcgagcaccgcaaagacagggcgagggggcggacatcaggcgagccgcagatgccgaggagacacgccgaagagaagccggcggggctgccagtatacga

SEQ ID NO: 294423 - DNA, 1857 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgaaaaaaaaaaaaaaatcctattctcttctatccctctcctatctctccacttcctacctttcttctctgtcctatctcttcttttcctgctgtcttcaatcccattatcttccctgctatcattctcttctccttctttattcttctcaactcctctctctcaatctctgtcctctccccttgccttttctttcttcaaatactcatcctcttaccttcttcttccgcctctttacaccctctatgtttatgactttctcatcgtcatcgtccttctctctctatctccctcttca

SEQ ID NO: 294424 - DNA, 1672 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctggaaaaaaataaatacaaaaaactcgaggggggtccccggaccccaaattcgccctataagtgaggtcgtattccaaattaactggccggcgcttttacaaaccgtcgggaa

SEQ ID NO: 294425 - DNA, 1928 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggt

SEQ ID NO: 294426 - DNA, 1995 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggt

SEQ ID NO: 294427 - DNA, 1892 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggt

SEQ ID NO: 294428 - DNA, 1733 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggt

SEQ ID NO: 294429 - DNA, 1149 bp, Homo sapiens
  misc_feature (854)..(854): n is a, c, g, or t
  misc_feature (859)..(859): n is a, c, g, or t
  misc_feature (879)..(879): n is a, c, g, or t
  misc_feature (885)..(887): n is a, c, g, or t
  misc_feature (890)..(890): n is a, c, g, or t
  misc_feature (896)..(897): n is a, c, g, or t
  misc_feature (899)..(900): n is a, c, g, or t
  misc_feature (912)..(915): n is a, c, g, or t
  misc_feature (917)..(917): n is a, c, g, or t
  misc_feature (921)..(925): n is a, c, g, or t
  misc_feature (929)..(931): n is a, c, g, or t
  misc_feature (1115)..(1115): n is a, c, g, or t
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccacnaaacnaaacagcaactcactcattncaaatnnnaanaaattnntnnaattaaaatttnnnnanaaannnnnaaannnaaaaataagccaccaacccaccagagaaacccaagacaaaagcccgcccccccaagggacaagaaaaaagccgcccaaaagaaagggagcccaaggaagcgagacaagaagccacccaagaagggagcaccaaaaagacgcaacaagaaaagaagcccgccaagtagtaagccaaagaagcagngaaagcagccgctgccgctgatcgaagcgaagaa

SEQ ID NO: 294430 - DNA, 334 bp, Homo sapiens
ctgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagct

SEQ ID NO: 294431 - DNA, 219 bp, Homo sapiens
gggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgg

SEQ ID NO: 294432 - DNA, 858 bp, Homo sapiens
gggacgcacatggtcctgttcgtactccaggatggcggcgtaaagggcccgctgctcccgttcctccggggtcagggcgacttggctgcaaaacctcctggggagaaaggcacgcggtgggtgccggggccaggccctccccgcagcggccccaggggcgggcaggagtcccacctgttggcggcctcctggagccgcagccggcgctcctccatctttctctggagctgggtgcagagtcaaggggccgagcgtgggatctgagcgggccctcggttcccaaccccgtcccacacccggagaggccgggacgtcccagggacctcctctcggtgaggggctgtccccagggaggcctcctccagtggcgtcagctctctggaaatgtgacaagctgctgtctagaccccaggaagcccagtggtgtctggacaccagaggagtctctctcatcctcccggattgctctgaggccaggagctttgtgactctgccccctgaagcttctggaagatctcgggtggcagaaaaggagagagctttcctccttcatcggagtatacacggcggtgtcggccggcaggctggggaatgggagcagctgcaggcatggttggcttcaggcgtgttttccctgcaagccatgggtaaccaggggtcaagcggtgggccacatcccacagaggagatgcgggcttgggggatgccccaggagagccgcctactgcaggagacccaccaagcttggcggccgtcgactgggccctctccagacactgctgtgctagcttcagcatcttggaggtgtcggggggcacagtttccccagcttctgggggagggacaagaaggctggtc

SEQ ID NO: 294433 - DNA, 1804 bp, Homo sapiens
  misc_feature (1536)..(1536): n is a, c, g, or t
  misc_feature (1541)..(1541): n is a, c, g, or t
  misc_feature (1557)..(1557): n is a, c, g, or t
  misc_feature (1560)..(1560): n is a, c, g, or t
  misc_feature (1604)..(1604): n is a, c, g, or t
  misc_feature (1607)..(1607): n is a, c, g, or t
  misc_feature (1620)..(1620): n is a, c, g, or t
  misc_feature (1695)..(1695): n is a, c, g, or t
  misc_feature (1745)..(1745): n is a, c, g, or t
  misc_feature (1752)..(1752): n is a, c, g, or t
  misc_feature (1758)..(1758): n is a, c, g, or t
  misc_feature (1770)..(1770): n is a, c, g, or t
cacccaggagccacacagacgcccgggaccagcacaggctcccctctgcaggtcaaggcactcaacactggggtgctgaggacacgggggtgcgccctccaacaagggctgtgctgggacaggcccagctgtgaggccgcagttgacctcccagagggacacgggtctgctgctccagagacgcggccctgccaggagggctccgtgagtgcacactctcctctgggcttcccgggtgcggggcctcccctggcacagcacagcccctcacagcacaggcctcgctgggctctagctctgtatctgtgctcctggcaggccagcaccccatcgcaatgtcctgtgcctctcagggcccagggtgacccctccccagcacagctgccctgcaggactcctgccagtcccattcacgctggcctgcccccagcctgtccccgcaggactcctgccagtccctttcacgctggcctgcccccagcctgtccccgcaggactcctgccagtccctttcacgctggcctgcccccagcctgccatttcagaggcagccttggtaaccaatgctcaaatgaccactgcccaggccagaatctcagaggaggccacaggtccccggtatgttctgatggggcagcctccgtgggggatccctgggccctgaacaccctcctttctcactgtccctccctcccctgcgaagggcatcctcagctgcttctgaaacctggggcgctgtggtgggaaacagcccagacaggctgttctcaacactctctactgcaaactacacacagttttacgtcgccagaaagaccccaaatttctattcaaaaagaccgtaccagtttcagttcccgccaacctcaaaggcagagacaaaaggacggtgtgcccctcctgtaacttcatttcttcggtgactgtgaagctgagggcagagtccacgcctggggacagggctgccaccgcagcggccactgagtccaaccctcgctcctcctcccagagacgacctgcgttccgctcagggacagggctgccaacgcagcggccaccgcacccaacgctcgctcctcctcccagagacaacctgagctctgctcagaagcggcacctcctcatgctggactcactcgggcccacatgtgccaagggggcctggttttggggccggcgggttctgcctgatgctcagagggtaactggatgctgaaaactgtgagtctttcttcaactcaggggaatgtttccagggcacgccaggcctcactcacgcaggcctccgcgacaactgttcagcactgactgagggtgaagtgaaatcctgaaagctgagagccagcgccctcacacgagggctgggacgtaacaaaagcccatcaagagtttatgcccagggctttcttgggccttgaagcatgacgagaccaggacccgtttaggattaaacaagttttactgggggtctgaaaaaactccccaggcctccacaaacaagtggagaaggaactccccaaacctccatgatttagnagaanacaagataagggtaancanctgggcccatttagatcaagtaaatttactgagtcttcagaggnagntcttcaggaccanacctcagttagagatgagaagaattgaatcacgtacgtctttagacgaatgcacactgacacggagacacagagnttagaaggtgtgtaagctctggaaaaactgtaatctggagttggtctggngatcatnccaggncttctccctgtnaccagttacagaaataaaatccctcttcttcccc

SEQ ID NO: 294434 - DNA, 1671 bp, Homo sapiens
  misc_feature (1403)..(1403): n is a, c, g, or t
  misc_feature (1408)..(1408): n is a, c, g, or t
  misc_feature (1424)..(1424): n is a, c, g, or t
  misc_feature (1427)..(1427): n is a, c, g, or t
  misc_feature (1471)..(1471): n is a, c, g, or t
  misc_feature (1474)..(1474): n is a, c, g, or t
  misc_feature (1487)..(1487): n is a, c, g, or t
  misc_feature (1562)..(1562): n is a, c, g, or t
  misc_feature (1612)..(1612): n is a, c, g, or t
  misc_feature (1619)..(1619): n is a, c, g, or t
  misc_feature (1625)..(1625): n is a, c, g, or t
  misc_feature (1637)..(1637): n is a, c, g, or t
cacccaggagccacacagacgcccgggaccagcacaggctcccctctgcaggtcaaggcactcaacactggggtgctgaggacacgggggtgcgccctccaacaagggctgtgctgggacaggcccagctgtgaggccgcagttgacctcccagagggacacgggtctgctgctccagagacgcggccctgccaggagggctccgtgagtgcacactctcctctgggcttcccgggtgcggggcctcccctggcacagcacagcccctcacagcacaggcctcgctgggctctagctctgtatctgtgctcctggcaggccagcaccccatcgcaatgtcctgtgcctctcagggcccagggtgacccctccccagcacagctgccctgcaggactcctgccagtcccattcacgctggcctgcccccagcctgtccccgcaggactcctgccagtccctttcacgctggcctgcccccagcctgtccccgcaggactcctgccagtccctttcacgctggcctgcccccagcctgccatttcagaggcagccttggtaaccaatgctcaaatgaccactgcccaggccagaatctcagaggaggccacaggtccccgcccagacaggctgttctcaacactctctactgcaaactacacacagttttacgtcgccagaaagaccccaaatttctattcaaaaagaccgtaccagtttcagttcccgccaacctcaaaggcagagacaaaaggacggtgtgcccctcctgtaacttcatttcttcggtgactgtgaagctgagggcagagtccacgcctggggacagggctgccaccgcagcggccactgagtccaaccctcgctcctcctcccagagacgacctgcgttccgctcagggacagggctgccaacgcagcggccaccgcacccaacgctcgctcctcctcccagagacaacctgagctctgctcagaagcggcacctcctcatgctggactcactcgggcccacatgtgccaagggggcctggttttggggccggcgggttctgcctgatgctcagagggtaactggatgctgaaaactgtgagtctttcttcaactcaggggaatgtttccagggcacgccaggcctcactcacgcaggcctccgcgacaactgttcagcactgactgagggtgaagtgaaatcctgaaagctgagagccagcgccctcacacgagggctgggacgtaacaaaagcccatcaagagtttatgcccagggctttcttgggccttgaagcatgacgagaccaggacccgtttaggattaaacaagttttactgggggtctgaaaaaactccccaggcctccacaaacaagtggagaaggaactccccaaacctccatgatttagnagaanacaagataagggtaancanctgggcccatttagatcaagtaaatttactgagtcttcagaggnagntcttcaggaccanacctcagttagagatgagaagaattgaatcacgtacgtctttagacgaatgcacactgacacggagacacagagnttagaaggtgtgtaagctctggaaaaactgtaatctggagttggtctggngatcatnccaggncttctccctgtnaccagttacagaaataaaatccctcttcttcccc

SEQ ID NO: 294435 - DNA, 2319 bp, Homo sapiens
cacgcacctggtgttgggtcccatctgcgctcattaggcgcgacgtcaatgccgcactgaggtgtgcctggcttcgatctaccctaggaagggtctgccctggggcgccccattccgcgactgtccccagtgggaaccacgccctccatctaccagagccatttctgcaacgtctagcaccccgcgggtcctcttccggccgcggttgccctgggcaacgcgtggagccgcgcttcctgtattgatttgaatcgcgggagacgtcacgtcctcccgagatgcccaacgcgcgcaggcgcagccactcggagtgggcagggcctggctgggtgttgggcagggcctggcggtgtgtggggtaggcggggggcgtggccgcgattagccgcgcgcggcgtgggggcgtggtcgggttgcgggggtgcgcgcggccggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtg

SEQ ID NO: 294436 - DNA, 1800 bp, Homo sapiens
cacgcacctggtgttgggtcccatctgcgctcattaggcgcgacgtcaatgccgcactgaggtgtgcctggcttcgatctaccctaggaagggtctgccctggggcgccccattccgcgactgtccccagtgggaaccacgccctccatctaccagagccatttctgcaacgtctagcaccccgcgggtcctcttccggccgcggttgccctgggcaacgcgtggagccgcgcttcctgtattgatttgaatcgcgggagacgtcacgtcctcccgagatgcccaacgcgcgcaggcgcagccactcggagtgggcagggcctggctgggtgttgggcagggcctggcggtgtgtggggtaggcggggggcgtggccgcgattagccgcgcgcggcgtgggggcgtggtcgggttgcgggggtgcgcgcggccggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtgctccgtgtcgatacactgcagtggtcctcgtgccgaattc

SEQ ID NO: 294437 - DNA, 6027 bp, Homo sapiens
  misc_feature (4134)..(4134): n is a, c, g, or t
cacgcacctggtgttgggtcccatctgcgctcattaggcgcgacgtcaatgccgcactgaggtgtgcctggcttcgatctaccctaggaagggtctgccctggggcgccccattccgcgactgtccccagtgggaaccacgccctccatctaccagagccatttctgcaacgtctagcaccccgcgggtcctcttccggccgcggttgccctgggcaacgcgtggagccgcgcttcctgtattgatttgaatcgcgggagacgtcacgtcctcccgagatgcccaacgcgcgcaggcgcagccactcggagtgggcagggcctggctgggtgttgggcagggcctggcggtgtgtggggtaggcggggggcgtggccgcgattagccgcgcgcggcgtgggggcgtggtcgggttgcgggggtgcgcgcggccggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagnccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttacagtgaggtggcgttcagtaccttcaccacgccgtgcagccatcccatctgattccagaacattctcatcacccagaaggcagccctgtccccattatgtcacctagtcacccccaggtccccctccccagtcccggcacccacgaatcctctccctgattctgtggattggtctgtcctggacatttcatagaagtgggatcacagcgtacccttctgtgtctggtgtctctcactgagcgtgacatcctcaaggtgcatccgcactgtggcctgggtcagagcttcgcacctccttgtggctgagtctcgttccagcgcgtgggtgcgtgggtggccgcgcgtgctgatcccctcaccttcactgggtgttcggtgttctc

SEQ ID NO: 294438 - DNA, 4558 bp, Homo sapiens
cacgcacctggtgttgggtcccatctgcgctcattaggcgcgacgtcaatgccgcactgaggtgtgcctggcttcgatctaccctaggaagggtctgccctggggcgccccattccgcgactgtccccagtgggaaccacgccctccatctaccagagccatttctgcaacgtctagcaccccgcgggtcctcttccggccgcggttgccctgggcaacgcgtggagccgcgcttcctgtattgatttgaatcgcgggagacgtcacgtcctcccgagatgcccaacgcgcgcaggcgcagccactcggagtgggcagggcctggctgggtgttgggcagggcctggcggtgtgtggggtaggcggggggcgtggccgcgattagccgcgcgcggcgtgggggcgtggtcgggttgcgggggtgcgcgcggccggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcaaaaaaaaaaaaaaaaaaaaaaaaaaaaaaaaaaggggggggggcaaaatttcccccgggggggccccacgctttttgcgcggtccccccggcttttctttgtcaccaaagggcgggcgcccctatatatgggggcggcgaattataattagcactaagggcacgtggcccgctgttttaccacaaccgctgcggcgcgacgcgtggggaaaaacatctgtcctcacgtggcggagaacatcctgtggggagaaagagagcgacccccttaacattccgcgggcgcggggcgcacccaatatgtgcgcgaccaacacctcccccctagcagacagtattttaacggcccccgcgagggggcaatattaagaattttcaggcgtgtctttacggtcggtgtacaaccacacaggcgcaattattctctgggccgccgtgaaacagatttggccacacggaacttatcaacttatgggacaatcttttttcccga

SEQ ID NO: 294439 - DNA, 5760 bp, Homo sapiens
  misc_feature (3867)..(3867): n is a, c, g, or t
cacgcacctggtgttgggtcccatctgcgctcattaggcgcgacgtcaatgccgcactgaggtgtgcctggcttcgatctaccctaggaagggtctgccctggggcgccccattccgcgactgtccccagtgggaaccacgccctccatctaccagagccatttctgcaacgtctagcaccccgcgggtcctcttccggccgcggttgccctgggcaacgcgtggagccgcgcttcctgtattgatttgaatcgcgggagacgtcacgtcctcccgagatgcccaacgcgcgcaggcgcagccactcggagtgggcagggcctggctgggtgttgggcagggcctggcggtgtgtggggtaggcggggggcgtggccgcgattagccgcgcgcggcgtgggggcgtggtcgggttgcgggggtgcgcgcggccggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagnccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttacagtgaggtggcgttcagtaccttcaccacgccgtgcagccatcccatctgattccagaacattctcatcacccagaaggcagccctgtccccattatgtcacctagtcacccccaggtccccctccccagtcccggcacccacgaatcctctccctgattctgtggattggtctgtcctggacatttcatagaagtgggatcacagcgtacccttctgtgtctggtgtctctcactgagcgtgacatcctcaaggtgcatccgcactgtggcctgggtcagagcttcgcacctccttgtggctgagtctcgttccagcgcgtgggtgcgtgggtggccgcgcgtgctgatcccctcaccttcactgggtgttcggtgttctc

SEQ ID NO: 294440 - DNA, 4973 bp, Homo sapiens
  misc_feature (3080)..(3080): n is a, c, g, or t
catcgaagacgcttgcaagcagcacgactctataggatccaccgatgtgcgctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagnccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttacagtgaggtggcgttcagtaccttcaccacgccgtgcagccatcccatctgattccagaacattctcatcacccagaaggcagccctgtccccattatgtcacctagtcacccccaggtccccctccccagtcccggcacccacgaatcctctccctgattctgtggattggtctgtcctggacatttcatagaagtgggatcacagcgtacccttctgtgtctggtgtctctcactgagcgtgacatcctcaaggtgcatccgcactgtggcctgggtcagagcttcgcacctccttgtggctgagtctcgttccagcgcgtgggtgcgtgggtggccgcgcgtgctgatcccctcaccttcactgggtgttcggtgttctc

SEQ ID NO: 294441 - DNA, 3552 bp, Homo sapiens
  misc_feature (1659)..(1659): n is a, c, g, or t
ctgcccacgttgcacagaacagaccaccagacgtgggcagttccaggaagtgcccacgtctgcacagaacagaccaccagacgccagggctgattggtgggggcctgagacccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagnccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttacagtgaggtggcgttcagtaccttcaccacgccgtgcagccatcccatctgattccagaacattctcatcacccagaaggcagccctgtccccattatgtcacctagtcacccccaggtccccctccccagtcccggcacccacgaatcctctccctgattctgtggattggtctgtcctggacatttcatagaagtgggatcacagcgtacccttctgtgtctggtgtctctcactgagcgtgacatcctcaaggtgcatccgcactgtggcctgggtcagagcttcgcacctccttgtggctgagtctcgttccagcgcgtgggtgcgtgggtggccgcgcgtgctgatcccctcaccttcactgggtgttcggtgttctc

SEQ ID NO: 294442 - DNA, 297 bp, Homo sapiens
gtcttaaaattaaaaaaaaaaaaaaaaaaaaggctccaaccttggtttctgcttgtggtggccccagcctgcccctccctcctggctccagagtctggggggcccagccacccgacaccttgctcccctctccttcagtcccccagcactgtcccgaggcacctagaggcccagagacatggggtgcttccctcctgtccacaggcaatgtcccctgatggggaggccatcgtcactggtgctggagacgagaccctgaggttctggaacgtctttagcaaaacccgttcgacaaag

SEQ ID NO: 294443 - DNA, 1375 bp, Homo sapiens
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294444 - DNA, 1128 bp, Homo sapiens
  misc_feature (1093)..(1094): n is a, c, g, or t
  misc_feature (1106)..(1106): n is a, c, g, or t
gccagtgaattcgggggctcagccctcctccctcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaatnnaaatcttaattnatatccttcttgaacaacctgt

SEQ ID NO: 294445 - DNA, 2051 bp, Homo sapiens
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaaggcccacctgaaagcctgtctcttcccactttggtgggcccttccagggggattatcgagcatgtggttttgccatagtgccttttgcctaattacagggttgcttctga

SEQ ID NO: 294446 - DNA, 1638 bp, Homo sapiens
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagaccccagaagagaggcgaggctaagcccagagcgctgggttgctttcagcaggggaagacttcctttccccctggtttcaagg

SEQ ID NO: 294447 - DNA, 1265 bp, Homo sapiens
aggagggctgagccaggccgagccaggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294448 - DNA, 1721 bp, Homo sapiens
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaaaaaaaaaaaaaaaaaaaaaaaaaaaaaaaaaaaaaaaaaaaaaaaaaaaagacaaaaaaaaaaaaaaaaaaaaaaaaaacatagaaaaaacagagcaaaaaaaaaaaagggggggggggggacagaaactgacaccccggagagaaaaaagaagcgcacgacggggagagaaggaggaaacacaaaagggagggggaaaaaaatacacgaggggaggggggcgagaagaaaaaagacgagagaaggagcacagacaaaaggacaaagacgtgagaaaggaggaggaagagcaaaaaacacaagaatgtgggcgggaggacaaacagagagagagaaagacagaa

SEQ ID NO: 294449 - DNA, 1414 bp, Homo sapiens
  misc_feature (1379)..(1380): n is a, c, g, or t
  misc_feature (1392)..(1392): n is a, c, g, or t
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaatnnaaatcttaattnatatccttcttgaacaacctgt

SEQ ID NO: 294450 - DNA, 1160 bp, Homo sapiens
cgtggagagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294451 - DNA, 1142 bp, Homo sapiens
aggagggctgagccaggccgagccaggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294452 - DNA, 954 bp, Homo sapiens
gagcttttccccaggcgcctttgtcatgagtcagtagggagtccagtgggctttggcctggggggcccattttcaaatgtctccctctatagaaagagtgacccacggttagtgccttggtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294453 - DNA, 1206 bp, Homo sapiens
aggagggctgagccaggccgagccaggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaa

SEQ ID NO: 294454 - DNA, 1638 bp, Homo sapiens
ggcagtatgcaagactatatatatgaaacttagctaattacaagaggctacgacaaaattaataatggaccaaacatatttatactaataaaaaagtttctcaaattttcaagtctatttgagtttagtttagagttcatgcacagacatgaatatgttttatttgatatcctactattgagacagaaaaattccaaccggcctgcccactgaggtggtctaaatgcaatcatgattgcatttagaccaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaaggcccacctgaaagcctgtctcttcccactttggtgggcccttccagggggattatcgagcatgtggttttgccatagtgccttttgcctaattacagggttgcttctga

SEQ ID NO: 294455 - DNA, 1106 bp, Homo sapiens
agacgttccggttcacgggggtgacataattgcggggaaacatgccggtctccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaaggcccacctgaaagcctgtctcttcccactttggtgggcccttccagggggattatcgagcatgtggttttgccatagtgccttttgcctaattacagggttgcttctga

SEQ ID NO: 294456 - DNA, 688 bp, Homo sapiens
aggagggctgagccaggccgagccaggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcgaagtggaggttgagtgagccgggaccgtgccattgtactccagcctgggtgacagagcgagattccgtctcaaaaaaaaaaaaaaaaaggcccacctgaaagcctgtctcttcccactttggtgggcccttccagggggattatcgagcatgtggttttgccatagtgccttttgcctaattacagggttgcttctga

SEQ ID NO: 294457 - DNA, 762 bp, Homo sapiens
aagccatcgccaaatatgacttcaaagctactgcagacgacgagctgagcttcaaaaggggggacatcctcaaggtaagtgctgatgccgagcacaatgctgagatcgctctccctgtgctcacccaccttctttcgccctgattacacacaaagaagctgtgtttttcattgtacacttttaacatttaccatcatatttgttctggagagctttagatgctgagtagaatattaaatatgacttaagtgagttggtgtgatgtgtggtgtttaactgcctttgtgtgaatgcctcatttgtctgttgatactggtaatatttcaagtaaagtcaaagtaatgtgattgtagaaaggaagtatatgagtagattgatttgccctgtagagttttattttaaaaatagcattttttaaaaagacccagacctgaagtatttatgtaaaagcattcagttagtcttactttgtatagccaaaggattttgcgttctggaatatgattttggtaggttagaaattaattttcccagtttagagaggttgttagaagtacataccaaaactcattaaagaacttcagtgtatttttattctttgtgaaaaaacaaatggagttctaaataataaggtgcaacctgctattgtacaagtcagatttcgactttcttaaaagaaacttgaggagcaattaccccatattaaactctaattgcacgaaaagaaacctgctgacagtttaaaaatcagcttctatacca

SEQ ID NO: 294458 - DNA, 5263 bp, Homo sapiens
  misc_feature (150)..(150): n is a, c, g, or t
  misc_feature (685)..(685): n is a, c, g, or t
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacangcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggagganatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggcaaaaaaaaaaa

SEQ ID NO: 294459 - DNA, 3947 bp, Homo sapiens
agctgctttaatagggagatcaagatgaatttgatgtataatcagaatcctagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggcaaaaaaaaaaa

SEQ ID NO: 294460 - DNA, 3342 bp, Homo sapiens
agctgctttaatagggagatcaagatgaatttgatgtataatcagaatcctagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgactgggggagcctgctagtagtcgaccgggaa

SEQ ID NO: 294461 - DNA, 540 bp, Homo sapiens
atctctgtttgccaaagtgctgtttgaaatgttaaatgctaaagggtgactcggaagcatagaaactagagggaggtctgtgactcctccatggagtttccttcttctctctgggcagatggcagagggcaggcctgtgtgcctagtgcctggccacttccccacacctgccttggagtgaatgtgctagatctgagagcccgcaagtctctcctggtggctacccctgagcgagagggatggtcctctacctccgggcttgctgactttaaacctttattgttctcctgtttaaaaaacactttccaaccttcttgcttttcttttctttctctgtctgttctgtccagaaccaaactgtcttgctaactgccccctggggactctagccctgcccgcctcacgctgtaagtgcttccttccttgtttcccaactgtctggagaggtcgtgttgtgtaactcgcagttggcacctgacgctcatcacctgagggagttctgcccggtggcggtaccctcgctcaccccaagttccagga

SEQ ID NO: 294462 - DNA, 432 bp, Homo sapiens
aagacgggtcagttccagaaattctcattagcctgctttataatgccacaaatgggagactatcagcagaagtgataaaaggcagccacttaaaaaattgggcagcaaacagaccacccaatacatatgttaagttaactctacggaaatccacggatcaagagatgtccaaatgcaagatatccatccgcagagggcggccaaatccagtatacaaggaaacttttgttttcaaagtgaccctatttcagctttctcatgtgacactcatgctgtctgtgtataacaaaagcagcatgagaagaaagatgataggctggatttatttaggtctcaacagctctggagaagaactcaatcactggactgaaatgaaagagtcaaaaggacggcaagtacgtagatggcaggcgttgctagagtcacgatgaa

SEQ ID NO: 294463 - DNA, 228 bp, Homo sapiens
tgcataagagggttgataaaatggaattcaagtgaacattttatgtgaagaactgcagtaatgaattctgaatttgttcaaatcattgaagatgtgtgaagacaaaacattcactcaaatctctatcatgttagcatgttatttatcattgctctgttcttcattgttgaataatgcaattgagttaaaaagaataaacattatttaccgaagactcatatgttgata

SEQ ID NO: 294464 - DNA, 564 bp, Homo sapiens
aactggctggatcacactgtcagccaagaaaaggaaggacgaatgaggctgaagagactgcagggctgcagatgaaatatccagacctatgcatcctcatgtgggatgagtgggttccggcaaaatttaagaggctaatgatgggatggaggggttggcagcagcacagcatagcagaattttctgattcactaccactgctggtgttacagcgtgaacgtgacctgaagacaaaaaggcatgggtgaatccaactatgcaagttttctggatcagtcctaaacagctggctgagcagtgctggaaggagtcacacaaaagcggtgtattacactacaaatccatgttcattaacttcaagtggggccacaccacggttcagcaatcctgccacttttcacagatctaagtacaaagtggtttcaaactctccaccctgcaaccctctgacccacagtactcctgtttcagcaaatgattttgttttctccttccgaaggaaaaagcagcctccagatgtaactctttcatcttcctgctaccaaaaataaaaacttaccaaca

SEQ ID NO: 294465 - DNA, 636 bp, Homo sapiens
aactggctggatcacactgtcagccaagaaaaggaaggacgaatgaggctgaagagactgcagggctgcagatgaaatatccagacctatgcatcctcatgtgggatgagtgggttccggcaaaatttaagaggctaatgatgggatggaggggttggcagcagcacagcatagcagaattttctgattcactaccactgctggtgttacagcgtgaacgtgacctgaagacaaaaaggctgtacagaatcattgtcacttccacaggaggggtttcggcgacgcgtgtaagggaactttggcgacttagtgcgatcactgggagaattgtagagtccactggagagaaagaaaaatggtcaaaaagagcccagagagttcctgggggaaaacacaccgcagcccagacctattcataactgcacagctggtacttccagaggcacatgcaccaggggcacgtggttctctttgctgacaagatttattaaaagaaaagaggaaagaactattctaaaatggaccctccctccaaaaaagcccaaacagccaaagcaattctaagcagaaagaacaaagctggaggcatcacactacctgacttcaaactgtactacaaggctacagtaacaaaaa

SEQ ID NO: 294466 - DNA, 532 bp, Homo sapiens
aactggctggatcacactgtcagccaagaaaaggaaggacgaatgaggctgaagagactgcagggctgcagatgaaatatccagacctatgcatcctcatgtgggatgagtgggttccggcaaaatttaagaggctaatgatgggatggaggggttggcagcagcacagcatagcagaattttctgattcactaccactgctggtgttacagcgtgaacgtgacctgaagacaaaaagcagtaagtgttaaaatgactggagccctttggatggtgcagtgcacgttaattaatggcctcacagtaatatgagggcagcctcaatcatttcactggatgatcctttgaaagaagccagcggaaaatgaacctcagtgtagaagtcaagtctggatttgggagtgtatatgctgcaaactatttcaagcaattattttgtatgaaaatatgcaaatttagccatattttagcaaaatgtaattaagctcattttcaaatgtattaaaatgactatctgctcaacatgtgtaat

SEQ ID NO: 294467 - DNA, 680 bp, Homo sapiens
aactggctggatcacactgtcagccaagaaaaggaaggacgaatgaggctgaagagactgcagggctgcagatgaaatatccagacctatgcatcctcatgtgggatgagtgggttccggcaaaatttaagaggctaatgatgggatggaggggttggcagcagcacagcatagcagaattttctgattcactaccactgctggtgttacagcgtgaacgtgacctgaagacaaaaaggctgtacagaatcattgtcacttccacaggaggggtttcggcgacgcgtgtaagggaactttggcgacttagtgcgatcactgggagaattgtagagtccactggagagaaagaaaaatggtcaaaaagagcccagagagttcctgggggaaaacacaccgcagcccagacctattcataactgcacagctggtacttccagaggcacatgcaccaggggcacgtggttctctttgctgacaagatttattaaaagaaaagagttatcctactgatgctgtttgattctagcagaggaggagaaggaaagatggaagagagaggaaacagtgataaggaaatgaaagaaacagaagacttattttaaaatgcaattttagggacactgtggcacattttattgataaattataaccccaaataaataatgaatcacccaata

SEQ ID NO: 294468 - DNA, 718 bp, Homo sapiens
ggagttcccaccttgtcccaggcactgtcgtggagactgctttgctctgtggcctcgtgttccccgctgcctctcggtcttgcttttatccacatccagcctcatccacacccgccagggctcctccttgggatcttggggtgggccaaggcggtaccagttgcacagacggcccgggccttgtcagcggggagcccggtgctttggtggcttgtttttccctgtctttaataggaatcaagtgtgatatcatgaattgatggggggaagattaagaaggctttgtaagactataagttagtttgctgtgaagagtgtgcttattaaatgctttctgcaacacgaagactgcagcccttgactttgaaatcatctgtttttagaatcttgaaagaattgaaattagttttctggctgattcccttcccttccttcctagaaaagacaactggcagtgcagagtttagcatttaatttgaaagataaagtcttttgtgaattatttcctgaagtcgtggaggtaagaaagacggaagtgggtttcgccttcccctgcgttaaaacacttgagtttcacctctttccaaagagtaaaatctgtgtcctgaagctgcagacctccccaggggatggctcctctcccccaggagccccgaggcaggggaggcagaaagcctgggctctggggggtggcctgcggacagctgtgctggtgggc

SEQ ID NO: 294469 - DNA, 859 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtaaggattctgtgcttaggagaagaacaccaggcggtttttatattctcagtcagccttgcctgttcaacatcttttatttgcaaacagcagcctttctactttggatgtgtgctagttaaattggcttagttggaactcctcctcgtctgcttctccacacgctggaagtgtttgctctgctgatgtgtctcagcctgcagggccgcctgtagcgtctgtgttcaccagcctctgacaccatagggccatagctgagaaaaccagaccggggtaaacactgaagctggcctgttctactatttcttaagacccagtgcatatcatcaaaggaaaggcacatatattcagttattcagtgtgccttctgtgctgggcgcccccagggtttcgcaatccccaggacggtctctgagctaagtggaagtacccctgtgtggtggcacctggggcttcggtaggctgcaggacctgtccagcacctcagcccttc

SEQ ID NO: 294470 - DNA, 1276 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294471 - DNA, 1895 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294472 - DNA, 1273 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294473 - DNA, 1674 bp, Homo sapiens
  misc_feature (1579)..(1579): n is a, c, g, or t
  misc_feature (1584)..(1586): n is a, c, g, or t
  misc_feature (1595)..(1595): n is a, c, g, or t
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggttttggngccgnnnacggctgtnttcacagttcgcttatggggcgacgggggctcgccccggcggccggcccggttggtggcgccgggttcctcttggggcc

SEQ ID NO: 294474 - DNA, 1561 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcaggtcatgtcggggacttgaccactcggccgggtttcccgtcagctgggacacttgcagctgccccaggacgggcagcctcgatcctgatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294475 - DNA, 2085 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcaggtcatgtcggggacttgaccactcggccgggtttcccgtcagctgggacacttgcagctgccccaggacgggcagcctcgatcctggttcgtcagtggatcacgggagtctgtgtcgggggagggctgccgtcgagcccgccgtcgcctcgcccctgaactgttagactccagactgccccgtaaaccccgagagaaacgagcgtgcccgggactgtgcttagggccagcgtttctgggaaacccgggcggtgacagtgggagaccaccgccggccggcgagtgagacacgagcccggaacaagtctctaagcggcgccgggcctcgccatccacacctgccagttccctgcatcctttcagcccctggccaggtgtcacctcctggcgtccttttcagtgcctgccacttagtgcgtgtgtatttaactctagtccggttgccatcctcttgccagacccagataggaagcggctgaaaggtcgggcctcagcccggtgggaggtgggcagcgaagagtgtacagcgggcttggctggggcaggtcggtggccccgcgccctgctccaggggaaccagactgtgtaatctggcttccgaagaaaggatcatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294476 - DNA, 1405 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294477 - DNA, 1488 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgagatgagcagcaccagcagtaagagggctccgaccacggcaacccagaggctgaagcaggactaccttcgcattaagaaagacccggtgccttacatctgtgccgagcccctcccttcgaatattctcgagtggttcaagcgattctcctggctcagcctcctgagtagctgggattacaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294478 - DNA, 1861 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttaaaaaaaaaaaaaaaaaaaaaaaaaaaaaaaaaaaaaaaaaaaaaaaaaaagaggggggcgggcgagcatccaaaaaataatcaccctcccgagggggccacaaaactaacgccgaccaccaggatttgctggtgcacaagagggcgcccccaacaagggaaggacgaattataaagaagaagaggagacaggggggcgcgagcgatataaaacaaggctgctgggagggggcgaacaacacggtgaccaacacgggggaaaccacctggggggacaaggaggaaccccactaacaatccgcgcgggggggggggggcaccaacgagggtgcggcagccaacacactacccaacaggaagagaattttataaagaagccctaaaggggggagcaataattatatcaaaactttatagagagggtgtgaatatgggggttgtttaaacccacaagacaggcgaagtaattgtgaagtcgatgcggttgaaaaaaagtgtttggtgatcaaaacggaggatattggaattttatgaagaaaaattttcttataaaacaggggggttagtgtagtaaaataaaaagcga

SEQ ID NO: 294479 - DNA, 1142 bp, Homo sapiens
taaaagcacccacggtagaagagacgggggttttgaagccgtgtggctgtgtgacatttcaccttcatttgttcactgcctgaatgtgaatgtaattttggctgggttctataaaccccaggcttggaatgattcagattttggagaatttgctgtcctcaaatcccaagtaattttcttctctcccttaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294480 - DNA, 1395 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggaatcccagttctggatcatctgcaactagggcagccagagtgcgggagtacatctgtagggtgggccctccatcatcgtgtcattgcccatgaccagcgttggggatgccagcaggccgtggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294481 - DNA, 1497 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggaatcccagttctggatcatctgcaactagggcagccagagtgcgggagtacatctgtagggtgggccctccatcatcgtgtcattgcccatgaccagcgttggggatgccagcaggccgtggtgagataaggcccgggagcaggtgtccagggcgtgttaaagtacttgttacgatgcgtgtgtgtgccttcagctgatctgaagaatatataccaccgagtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294482 - DNA, 1376 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggcttgggggagggcgtcactattcagcttctaggtggaggcatgagaaggccttggcctagccctccagggtcccatactgtggagtttggaggggcaggtctggcctttcctgggtcagcatagggcacccaggtgggggcacaggtggacacccagcacaggcacctaggcggggtac

SEQ ID NO: 294483 - DNA, 1726 bp, Homo sapiens
ggagttcccaccttgtcccaggcactgtcgtggagactgctttgctctgtggcctcgtgttccccgctgcctctcggtcttgcttttatccacatccagcctcatccacacccgccagggctcctccttgggatcttggggtgggccaaggcggtaccagttgcacagacggcccgggccttgtcagcggggagcccggtgctttggtggcttgtttttccctgtctttaataggaatcaagtgtgatatcatgaattgatggggggaagattaagaaggctttgtaagactataagttagtttgctgtgaagagtgtgcttattaaatgctttctgcaacacgaagactgcagcccttgactttgaaatcatctgtttttagaatcttgaaagaattgaaattagttttctggctgattcccttcccttccttcctagaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294484 - DNA, 2780 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcaggtcatgtcggggacttgaccactcggccgggtttcccgtcagctgggacacttgcagctgccccaggacgggcagcctcgatcctggttcgtcagtggatcacgggagtctgtgtcgggggagggctgccgtcgagcccgccgtcgcctcgcccctgaactgttagactccagactgccccgtaaaccccgagagaaacgagcgtgcccgggactgtgcttagggccagcgtttctgggaaacccgggcggtgacagtgggagaccaccgccggccggcgagtgagacacgagcccggaacaagtctctaagcggcgccgggcctcgccatccacacctgccagttccctgcatcctttcagcccctggccaggtgtcacctcctggcgtccttttcagtgcctgccacttagtgcgtgtgtatttaactctagtccggttgccatcctcttgccagacccagataggaagcggctgaaaggtcgggcctcagcccggtgggaggtgggcagcgaagagtgtacagcgggcttggctggggcaggtcggtggccccgcgccctgctccaggggaaccagactgtgtaatctggcttccgaagaaaggatcatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacggcgcagagtattaatgatgcatactagcgaggacatgtgctcgttttcgtgatctagcgggattatccatcgcctgggacgacgatggtaaccccaggatcgtggttcgtgttctccgacgcaatcgcatgaacttggcgctccatgagacttcatggctgggagaagggccccgatgctgggcgagtcatgagagagcgtctggaatttcacgaaaacagaccaacctggcagtagccactagtttgagcgattcctcattctaggaatagtattaacgtcttttggtgaatttagtgtcctgtaagttcgtggagcgagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294485 - DNA, 1293 bp, Homo sapiens
ctgggtctaagactgtttcaaagaagagctcatagactgactggtccagaagacagagggtacaacagtggcatcacagtgacagtgtcatgtgggcctgtcccacaggggcgtggagctcgtggttctgagcagccaactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294486 - DNA, 1314 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294487 - DNA, 1435 bp, Homo sapiens
aaattaggctaggtacgaggctgggtttgaatctggcagcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccg

SEQ ID NO: 294488 - DNA, 824 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcatttta

SEQ ID NO: 294489 - DNA, 737 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgctgcgttcctttgcctgcaacaggggtcaagatgagttttgcctgacttctttgatgtcctgaactttccgtagtcctttttcttgaatttgttcattataaatatagcttggcatttgtttgatcttt

SEQ ID NO: 294490 - DNA, 917 bp, Homo sapiens
agcggggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaacagacaactggcagtgcagcagttcagcattctacagtttggacccgattaaggtctttggtggcattctttccctgaagtccgtgcaggacgattagacgaagagcggactgtccagccgaacccgtagcagaccccagactctcccttgccagacgtgtcccgacgggcacagccc

SEQ ID NO: 294491 - DNA, 648 bp, Homo sapiens
ggctcgggctggggctcgggctccgcgagcggcggcaggcggcggcggcccgaggcagcggtccgcgctctccgggcgcatagggaagccctgcctaatgcatggctgtccgcacgcggccgcctcctcggagcgaacacgcgcccacgacaaacggggggagcgggattaaggaaaaccccgagaatagagaatgaatgcattttgacaattcgtgaaaataatcactagtttagtatccgtggttgtaccagttctctgaattctaaagatgaaaagatcattgagaacatctttgttactggcactgtctacatggtattttgagcagagttttgcagtgtttccaagtgctgcagtttcttcccgcagagagatggccactacagactctagctgccagaagaatttcccccagatctggaaagtttctacagttgcttacctcgaatattcacatacagagaggtacttcctccaaagtgcggttttccaacaactccataatgataacatgggaactggacctggctctgccaacagatgtcaatactttcacgatgaagagaaatagcgattccttcatgatctgcttcaaaatattggaatagattttagtgattctggaatggatgagaagatttgaca

SEQ ID NO: 294492 - DNA, 427 bp, Homo sapiens
ggctcgggctggggctcgggctccgcgagcggcggcaggcggcggcggcccgaggcagcggtccgcgctctccgggcgcatagggaagccctgcctaatgcatggctgtccgcacgcggccgcctcctcggagcgaacacgcgcccacgacaaacggggggagcgggattaaggaaaaccccgagagtgagtagtcacttcccgacggcctcgctgcctgactcaggacccagccgggggtcgccgcccccacaagtttcctcctccgtaccggtgtgaagcgagaaaacccccgccctggcgcgcacgctgggccggctcaggtgaagcggggcctgcgcccccgcgcactccccacgccgggagccgaggaaaccaaaaagaaagacgcggcctttcgtttccccacctcgctggagggcgccgg

SEQ ID NO: 294493 - DNA, 368 bp, Homo sapiens
ttaacttcaataagaacaacttttggagcggtcactggcaggttaacatgccaactttttcaactttgacattccacagatgtcaactctaacactaatgatagaaagttatgaaatctctgacttccaagggtgagtaattgcagatggaatcaaaattcccattgcttgcttgctttttcaagtaaggattgtatcaaaaaataccagaattctcaaacagtttatgagttagattctatttgtgcctttttttttttccccagatcattgagaacatctttgttactggcactgtctacatggtattttgagcagagttttgcagtgtttccaagtgctgcagtttcttcccgcagagagatggc

SEQ ID NO: 294494 - DNA, 310 bp, Homo sapiens
gaactagataacatggtaactttattcttcatatataaataaggcataatctgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294495 - DNA, 4970 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294496 - DNA, 4916 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294497 - DNA, 6407 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtcactctgttaccatttcatttattttagttttatttgagaaattaagaccagaagttttgctcatgtctttttcacttggaaatctgacttagtacctagttaatttgtctctctcccatcattttaaggcgttcgcttctgttaatcacagatgatctgtccttgtgttgtgctgcttgactaaaagcactgttttgttttgttttgttttgttttttaatgataggatacagggtggcttttcagtctagtaaacatgaggaggggagagattgtgggtgggtgtgggtgtgtccgcatgtcccaaatacagcacatgcccatttttttatggtacgaggttagggcttattaataaatgtatactagatcttgaagtgtaagtctaagtctgaacattttaaacaagttggactttatggctttttcaagttccatcaagtagatactagtcttaggctggtaggtgattaacaacatcatttggagtacagtgtttgtaccactagcattcttatgtctgtacttgaacgtgtagttagcatttaagttatgttcactcttgtagcattcaggtcttaccatctggtttcaaatgcgagagcttatatgaacattgttttgaaagcatgaatgatatggcaatattttatgtcttgataaggagagttttgtgacatatacaaatctgctgttgatgatgaaagtttacaggtggatcagagtatgctggaactcagtgtgcataaaatttcagtcagtgaatatcactgaacgtcatatactacttggtatgtgactttggtttgtgttaagaaagcttgtatataatattttttgccatagtaagtgagaaattgtccttaatcatgcctgtttgatggtactaggaaagaaaggggtagagattaattcttgcacagtataagcaacagtgcaacaaactatgccatttaccttttacctcttacttgaaggcagaatcgcaaaacgtttgaaatggcttttctaaactactctactctggtgagagctcatttaccacaagaagccttataaaaaagtatattttgtaataaccccgtagatactgtacctaacaaaacatgactcgtattagctctataaaatatttgtggcttaggattttttttttacatatatctttttataactttccaggaactaagcacattatctgataattgttgtaaatttttttgtcagtgctttagttcaggatgggcaataaattatttctaaaggaggtctaaaagtggaaagaatggtttgattttataaaatgagttgctagttcattacagctttttacttttgtacatattttgcaaaacatttgcctcttgctattaatatttgctttgtaaaaattactgacatttaataaacatttgtaaacaattcaaaaaaaagatg

SEQ ID NO: 294498 - DNA, 4916 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaagcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294499 - DNA, 4724 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcgtacaggttactatgcaatcccgaatatctgtgtatcgacgctcaggatcaatgtagcatgcagcgactgaatcgcactactacgaggtatgcctcatttatgtgatgtagacagatagagcatgttatagatg

SEQ ID NO: 294500 - DNA, 2442 bp, Homo sapiens
ggctcatacggattcatgtatcacacttgctcagctcaggtctgcaacagtccgagctcttcttatgcaggctgtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294501 - DNA, 4627 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaacaagtgaatgagttttttcattccatattgctatctttggttgcagagcaatccagtgccctttccagataataaaattgaaatgaagatttcaatttaatatttggcagacagcaacaatgc

SEQ ID NO: 294502 - DNA, 2022 bp, Homo sapiens
tgcgccgttaaacatcgtccggaattggaaaacccctgcgggcacgactgcgtaagcatggccgtagcgctgtcctgtgatcgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294503 - DNA, 4663 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgccccctctagagccaaaaaaaaaaaaaaaaaggaaaaaaaaaaaaaaaaaaaaggggggggggtaaaaagatttccttggaggggccccaaagttttgggtttcccggttttttggcaaagggggcccataagagggggggggaataagaagcaaaggagggaccgtcgtttacacaccgtcgcgaccggacacgcgtaccgtgggggatcccggggaggaccccacctgcgcggggtggcgcccacgcctgcagccacccacccacgaaatttagaggtcccaggcaataaaaccttcagcgtgtactgcgtagccagcggctttgcggcgcgcgaagttcgctacggctatgattggaatagcggagagacatactacaaaaacaaacaacagacaagacatagaaaaaacgccagaacacacagaaaagcaaacacaacaacaaaccatagc

SEQ ID NO: 294504 - DNA, 1221 bp, Homo sapiens
gtattttaaaaacgtttgaaaggattcagttttcatgatacaggtgtaagactcctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtc

SEQ ID NO: 294505 - DNA, 2765 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtggcatcgataaacaccgttgggtagaggtggcatcgataaac

SEQ ID NO: 294506 - DNA, 1604 bp, Homo sapiens
gcggccgcggcgtgcgagcgcgcctccgggaggcagcgggagcgcgcacgctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcgtggttccactggcatggccatccttacgggtgactttccatcccttgaaccaagggcatgttagcacttggctccagcatgtggtcaccattccaaccagaaatgggcacaaatgctactgtgtcggggtggtagcccaatttccttactgtaagtgctgacttccttaacaattccctcatatctct

SEQ ID NO: 294507 - DNA, 2512 bp, Homo sapiens
gttggaatggtgtgttttacagtctacctagaaaatagatggacaatatttttcaactgaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgagtttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctt

SEQ ID NO: 294508 - DNA, 2735 bp, Homo sapiens
ttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgagtttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctt

SEQ ID NO: 294509 - DNA, 2913 bp, Homo sapiens
ttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgagtttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctttaaaaaaaaaaacagacagaacgaaaagacaacaaaagtgtagggagcctagggccacaccgaaaagaggttaagaacatagcgaagggccgcgggcccacaagaggataaggagacgggggacaacgtggaccaagaagacaccggggagaaaaagagacgggaactcgacgaaaaa

SEQ ID NO: 294510 - DNA, 2616 bp, Homo sapiens
ttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgagtttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttatgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctt

SEQ ID NO: 294511 - DNA, 461 bp, Homo sapiens
gactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccaccttagcctggttttctgctactgttatttatcatcgtaggttctgagttgctcattgtggttgctctttggaccaataaaaatggcaagtatgagatg

SEQ ID NO: 294512 - DNA, 298 bp, Homo sapiens
agttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaa

SEQ ID NO: 294513 - DNA, 479 bp, Homo sapiens
aagtttcattggttcttctcatgttcatagttgtcttggatgcctgtgaatcagtaccaggtgcaaccacccccctgataagagattctgccactccttggtcctgaccaccctcctagacctggggtctggggctgctgccctgagtcagccactctttcctcacaggttatagatgtggctcccgagcttctgcgtatctgcagcctcattctggctgacaacaagatcccaccaggtgagggtaggagtcataggcagggttagaagggaggctactcacctctgggctgggtggggctggcagacgcagctcctccgggggggtcacctctgcaacaacacccaaggggctctgtcccataagccccttaccccttgcagatgccagggcaagaaactgcagggtcctccctttagcaagttgggatataaagcccttgtctgcagcagtatccaggtactcccagaaaagcccc

SEQ ID NO: 294514 - DNA, 3926 bp, Homo sapiens
tcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294515 - DNA, 3510 bp, Homo sapiens
ggctaggtagaggcgcgtggtgaatcggccgagggttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294516 - DNA, 3520 bp, Homo sapiens
atctgagtacaacgcacgagggcttggcatgctccaatgggagggtatccaagacacgcgggagctaaggcacgcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294517 - DNA, 2856 bp, Homo sapiens
caggctaggagaggcgggtttaaatcggacgaggatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294518 - DNA, 4014 bp, Homo sapiens
tcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaatagctctgagagcaagaaggctggaaatgcacattcagaaatgaggtaagcaggacccagtgaggcacgacgtggtttactagaagtg

SEQ ID NO: 294519 - DNA, 4006 bp, Homo sapiens
tcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctggtgaggagaggctgggccaggctgggggttcttggggaggggcagggcctgactggtgcttcagccaataatgtccccagctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294520 - DNA, 2619 bp, Homo sapiens
ggacgcgtgggtcgacccacgcgtcggattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaatagctctgagagcaagaaggctggaaatgcacattcagaaatgaggtaagcaggacccagtgaggcacgacgtggtttactagaagtg

SEQ ID NO: 294521 - DNA, 2906 bp, Homo sapiens
tcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaa

SEQ ID NO: 294522 - DNA, 507 bp, Homo sapiens
cctcaagtccctgatcctgacggccctgcagagagaaacagagtaagtacctacccacttctctcgggatcttgacgactttgtctaggtttctgccttccttttcggctccaggctgggacttgtggggcagggacttcagttctagacgcaaggtggagtgaggattttaaggctgttttgaagactaaagttcttgaggaagggtgatgatgatctgccaaacccaagtcagaagaataagactgaaattcaggctaagttagactgaacttaccagattacatgcccacagtgctgttgggctccctctgagctgctgtctcatgtgtcccaacttggcaaagaccctgtgcccacacctcctgaaagtttctgtcctggctgccccattgagcctggccactgtgtgcagaggaaggtattgaagggtgattggaggagatctctcctgtttgcaggcactgtgtgagcctcagcctggcccagctctcagccaccattttt

SEQ ID NO: 294523 - DNA, 2204 bp, Homo sapiens
  misc_feature (1)..(1): n is a, c, g, or t
  misc_feature (5)..(5): n is a, c, g, or t
  misc_feature (8)..(8): n is a, c, g, or t
  misc_feature (1045)..(1045): n is a, c, g, or t
ngccncgnaccagacggaagcgatgcgggagggcatgcccaggatgaaaacctgggccacagagcagatgagctggcccaccacggtgaccggaaagagatgcggcttcaggctgcccagcttcacccaggcccccaggcagttgagagccgagccagtgagagcaatggtgcgcaggccgaacttctccagcagccaagccactggcaggagcagagggatgtaagtcagcatgtagcacatggacaaccagtcaatggcaaaggcactgacaccgtagaagtgcatgaagatgttattgatggagccgtactggatccactgaaaggagttgcacatggagtagcagctaaacaccaggaccacggcccaacggcgcctgctcaccttgatcacgctgaggtcctcagggcccgagctactggggtgagccaagccactgggttgggctaaggcactggggtgggccgaactgctggggtggacagagacgctggggttgatggagacgctgggatggaccgagacgctgggatggaccgagacgctggggtccgcttggagtgcggactccggcacaggggtgtcatcgctctcttcctggttgggaccttcattcaccatcgccacagtctcctctggaatcctggagaagtggtgaggactccggcagtcttaagggacagtggcctctgctggtctcttagagttgaaaggacacttgcctattccagaagaaacagactagaggctgcgtaaaagcctcaagtggggcttcctgtgctcacctccaagctcctgctcccacttttgcttggggctctctgttgccacccgcggcgatcgctgtcccaaggccggccgcacacgccgcagccggctccggaccgctcctgccttgggtctccccacgaggcgttccttgtgcaggaaaagttctctccttgcgcagccacttcgcccgcagagtcctctcccgggccagcttggggcctcgcccagtcgggcacacgtgaccgccccgcccccgtcctgcctggcttcntccgcccccaacccccccgccaccactccacccccgacccagtgtctcttgccttctcgagcccggtcctccgggcagagcagttgtttcgccacagcttgcgggatgcattcctcccccacgccccgggcgccatggaaaccgcccggttaacccccaccctttgcactgcccctcatattcatttgccacccgctatcagcggaccctgcaagaagatccgccttcccgaagtaatgcccaaaatagagcctctccggtgcctgtccgcatgccctgcgcgcgtgcaccaaagcccggcgccacctaagtgttctggggaattcaagagggattccccaactttctcccccttggcttaggctcccagccctttgctgaactaaagagagatttgtagatttcccgggctggttgcgctcctgggttaaaggggagttacagaaaactcgctttactcgcttctttccctgcggacgtggttttgtcttggggaggttagatttgaacctgttatgtggggctatttttcctgatggattctgggcgaagaccctagggtgcgggggagggaaaggagagtttgaagaagccgaagaagctgtccgcggttgtgtgatggaacgcttagcacagagctggctccgggcttggtcttggaagcggtctttgaactcaagcagccctagtctgccacctgccggtcctagcccatttcaaagggcaaaccctcgactcgttgcactgacctctgtccttggcgagggatcctgataaggaaactgaggcctggagaggcgggtgtgttactcagcgtcctatagtgaaatagcatcagaacaagcagcaataaaatgggtgctccttccacgtggcctttcccatgagctcttctggggcagcccttcagcttgatttctagctgtctcaggacttgtggatatttttgtatattttggagtgtttagtgagataaactatgtaacacacgctctcaatacgtatctgtagaattgagttgtactgcatatcaccatgaaattttacaaaactggagacaaagaggagatccaacaggatttcagagattttaaaaaatcagaaaaagttaaaaaaaaaaaaccagatacaaaatatcaacacagttgcctcaagcctg

SEQ ID NO: 294524 - DNA, 652 bp, Homo sapiens
gttcctggctctattccaactgacaccttaggaagcttgagggaacgaacctctggcattgaactcaagcttgtgtggcctcttgcagaatgatagttaagtcagcccactggaggctatcagcaactcctggattcaaagccaaaacatcaccctcttatttatagcttactactagccaaacagagctatagatttaagaggtaaggagtttgttgagtgcaggggaaggccaaatttctaacagaatgaatcaggttgggagccggcattattctttcttaaaaatatcaacacttggaatttgtgaaaatgttgcccttacaagttttacatgcataatttatatgtgtgatactacatgctcatcaatattctgtttgccttatctcccccacttccctcagatttctagctgtctcaggacttgtggatatttttgtatattttggagtgtttagtgagataaactatgtaacacacgctctcaatacgtatctgtagaattgagttgtactgcatatcaccatgaaattttacaaaactggagacaaagaggagatccaacaggatttcagagattttaaaaaatcagaaaaagttaaaaaaaaaaaaccagatacaaaatatcaacacagttgcctcaagcctg

SEQ ID NO: 294525 - DNA, 760 bp, Homo sapiens
gatgtcacctggagcgagtagcgcgcggcgtggaacgcgagtcgcgaccccggctcccggcagtggcgcgcactagccctcgcgccgcacgggacacgagggctgggcgggcagcgggatgaggctaaaggttggatttcaaggcgggggctgcttccggaaagacgcgctgtgtttggaaggtggagtgagcgcccggtgggcgagggcacctcattctgcacccctgcgcccgcctcgggaactgcacgcggcacccccacccgcgactcccacgcagacagtagtgcggcctgcagggttcccccggcggacgaggctaatggttcgctccgccccgcccacacagaggccgcccactggctccggctgcgtttcaggactctggaggaagggacttggccttcgccctcagacgctcttaagggtaggcggcgttgtcctcagttctgccccagcactcagacccagactgggtccctgcctccgccctccgccctcggactagtctcttggaagccggcctgtctccgccttcagacctagggagaggtcttaacctctgttctcagactctggaaaaggcttctcaacggcttggcctgacctcagctcctcgcattccctccacatctcaagacaccaacccagggatgcaggacagacacacagacactcagtgagggtcaaatatctttaaataaagtgccaggaacaataaatactgtacaggaagagagtgcacgtgaacgtccagatc

SEQ ID NO: 294526 - DNA, 614 bp, Homo sapiens
ggtggcgactgcagaggtaacagtagctgcagatcctccccatgcatcgtgtagagctgagcctgtccccagccgtgcaccaccccgctcgggcccggccgcgggcagcaccgacggattcgtccctcgctccccaccccaggtccaccccgcagctctgggaaccccgggacaactagacagtgctttgccctgactcctttcccccactctccttcccttgggagttgcagcgcgagagtctccccccagcctggtctgacccatcgcttcccacctccattgatgcccccgcctccaaacctgccaggtgcccacaaccggtccccacccaggctctcccccttttctctaccccttcgttaccatcatcacgcatgcacaccctgggcacccttttctcatcctggccttttcttaaccactagaatttgacctgtgcagctggcagtacctctgcctctctcagggagaactgtggcgatgccgtaaggctggctgggagagtaggagtgttagggagtgcggacgggtcagggtgtagggactttctatccactctatgccaggctttgacttggggccataggagggaaagtgattccagccctcca

SEQ ID NO: 294527 - DNA, 363 bp, Homo sapiens
gcagccaccagtggggcttctctgctgtaaaggagataaaggacatggaaaggaatggctttggagtccaacaggccattgtcctggatttcatgatagactgcagtcctcaagcatttaggacggaagaaatgaacactatcgaggctctttgctcacatcgttatttgtgaagctcatcacaggcaggtaggcgactccgccgtgaacccttcagggaagttcagtgagcctgtggtttccttctatttgtagtaactagcagtgcctggcacatacacatcaatcagtatttggtgatccctatacgtttttattattgcctttatactatttttggagaaaagaaattcccacccgatt

SEQ ID NO: 294528 - DNA, 1607 bp, Homo sapiens
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggaggatttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttgaaagaaaaaaaaacgttgaaaaaaggaaggtttctttagctttagcttcttggcccaggaatttttcctggcattcaggttctgtgctgaaaccacaagggagggggaggttcccatttcattagcagtaagcttctgctgtgccataccaccaggctgcctgcctctaggaaaaccctgttccttttgatagaatctaaaaggggtaccagtgggtcccttgtagcaatacagactggatagtaatggccattagggcagaaagtagtctgagcagtgggagattttagttaacagctatttctgcttccaaactctgataacggttgtgaaattactgactgacttcctttggcagtggggccaagaaacaatatatatgaatgtgatacatgtgtttagtaaaatctagctttgaacatgg

SEQ ID NO: 294529 - DNA, 1034 bp, Homo sapiens
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggaggatttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtaagggggcccatgagcagacggggcatgaggcatcctaagctcttaatctaatcagaatgctttgcttccctgggctccactcccgaacaacattgtccttagttcttttcctcctgaaaaggaagaatttattctaagtgccttttaggaacctgactttatagtacagggaatttggggaaagatcatcttagattgatcatttttacattaatgaatattttacaaggtttgcaacatcacctttattgttatagctatccattcttaggggggaaatatgtatatggggcttatgataagataaagacgataaaatcagaaattcttaaca

SEQ ID NO: 294530 - DNA, 374 bp, Homo sapiens
tattggtgtctgataacagagaaatgaatcaaacaattgcatattcttttggggaggtttgtcaataacacgttaaaaggagaaaggtacaaaaatatttacaatatgactacaactcttacaacaacaaaaaatcctatacggaggggagaagtgacaaaatactccacggaggggagaagtgacaaaatactccagtgtgaaggaacttggtttagatgataggaaagtgattccttctttaaaaaaaaaagaattctatattcttttttatttattgagcaaggattttgcattacaatcgggaacaaaaacagacctttctgagaagagaaggggctcctgcagtagcctaggaaaatcacatttagaat

SEQ ID NO: 294531 - DNA, 1792 bp, Homo sapiens
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggaggatttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttgaaagaaaaaaaaacgttgaaaaaaggaaggtttctttagctttagcttcttggcccaggaatttttcctggcattcaggttctgtgctgaaaccacaagggagggggaggttcccatttcattagcagtaagcttctgctgtgccataccaccaggctgcctgcctctaggaaaaccctgttccttttgatagaatctaaaaggggtaccagtgggtcccttgtagcaatacagactggatagtaatggccattagggcagaaagtagtctgagcagtgggagattttagttaacagctatttctgcttccaaactctgataacggttgtgaaattactgactgacttcctttggcagtggggccaagaaacaatatatatgaatgtgatacatgtgtttagtaaaatctagctttgaacatggaagaaagtaattctttgaaaaccttttaaatctgaatatctaaaacagggagcggtagtgaaatagaaggttcagcattgattataaataccaaggacttaaggcaagggaggaaaaacaaagtaccttctgaacttagctttccactgagtaatgtttactcttcacagcacccaccacaaaaa

SEQ ID NO: 294532 - DNA, 1190 bp, Homo sapiens
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggaggatttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggtgggtggcagccccagaccgggagggactggtaggatctgagactgaggtgcaggcatagttgacaggtgcatcttaattgcctttccttctgagcgccagcagcccagccgcaactgagccatgctgtaggagacccaaagaccagtgtttcccagggcctcctgggggtgtaataatccatcaggcctggattcaaatctgtagttgtcattactttgctgtggctcttgggcagttacttcacctcactgagcctcattttctctccaaatgagatggttctgcatgaattttagtggttgagattatgtaaaatatgtagctcattgtctcttcccctgccccagtcaagaaaccaatgaagagaga

SEQ ID NO: 294533 - DNA, 967 bp, Homo sapiens
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggaggatttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggtgggtggcagccccagaccgggagggactggtaggatctgagactgaggtgcaggcatagttgacaggtgcatcttaattgcctttccttctctgtcattgagcgccagcagcctggccgcaactggtctttgggtctcctgtcgagc

SEQ ID NO: 294534 - DNA, 3850 bp, Homo sapiens
ctggaggaagagggctccaggcaggggaagcagctagggcagaggccctgaagtgggaccgtgtctggcgcattggaagagcagaaggaagctgatggggctggagcagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgtt

SEQ ID NO: 294535 - DNA, 478 bp, Homo sapiens
gaaacagtagcagtgctttacaatcttgtcatgcgttagtgcctgttgtccattttgcagatgaagaaactgaggctcagagaggtcaggtgatttgccctgtggctcacagccaggacctggtcttcagactccacatcccttgtgggtttggagttctgtagctgtatccccctcttaggaaagtgctggggatggtgtgaggtggggcaggaatgactgatggctgctgcttctacctcctgccaggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaaggtgaggggatagccagtccaaggtgacagcctgcgatggggaagggtgttagaca

SEQ ID NO: 294536 - DNA, 412 bp, Homo sapiens
tgtgtggtgatctagaggatccctcacgccatgtcacaatgtcagcaatgcagccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggtgagcgctggccgggggtgtccggcgtgagcaggggcaggtgttctcaatcctggccttactgacattgtgggtagcatcat

SEQ ID NO: 294537 - DNA, 6558 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294538 - DNA, 6486 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294539 - DNA, 6622 bp, Homo sapiens
  misc_feature (56)..(56): n is a, c, g, or t
atagggctcaagcgcccgcccgggcaggtccaccatgtaagaagtgcttttcgccntgcacaatgattctgagaaattccccagacatgggaactatattgatggagcagccactctatgctggacactgggaatctagcagtgaacaaaacaaattccctgccccagctgagctaacatcctaggcagggaatcaaacaatacggcctgggtggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294540 - DNA, 6428 bp, Homo sapiens
actcactatagggctcgatcggtactcctatagggctcgatcgccgaccggtcaagtgtcagtgcagacaggcctcacggaggagaatgtcagtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294541 - DNA, 6662 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaaggtgagcttcaggcctggggcagggaggaccacgggggccgggccaaggccaccaagcacaccggctcccaaccgcctgcccgcccccgacatctcccctcccagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294542 - DNA, 6444 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294543 - DNA, 6469 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294544 - DNA, 6516 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294545 - DNA, 6508 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294546 - DNA, 4612 bp, Homo sapiens
ctggaggaagagggctccaggcaggggaagcagctagggcagaggccctgaagtgggaccgtgtctggcgcattggaagagcagaaggaagctgatggggctggagcagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294547 - DNA, 4301 bp, Homo sapiens
cttactctggcttctggcagggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaaaaaaaatgtga

SEQ ID NO: 294548 - DNA, 5796 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgtt

SEQ ID NO: 294549 - DNA, 5310 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgtt

SEQ ID NO: 294550 - DNA, 4223 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccagtgagtgatttctcccatcccccac

SEQ ID NO: 294551 - DNA, 4800 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaaggtcggtgggcagggagggtgcatcatggtggggagggggccatggcttttggtgtggaacctgagagaatcaggaatggatccagttctgtgacccctgtttctccatgaccagggagaggacaagagaagtgatgccctctctcagctgagtgtcctgccctgggcaggatgtgacttgagcccaggagtttgagacctgggcaacatagtgagaccctgtctctatcaaaacaaaaatcagaaacaaaacaaaacaaaacaaagccctgactttggaggttgaaaaggctgaacctgttctttctcagcttccaaagcattggatgtgtgagttcctgttattatcagggtatgagggacaccggctggcagcccactgaccagattcaggcccacagataggtttcgatgctgcagcagcaaaaactgtgactctgcttccagcttgacaaaggttctcacatagaaacttggatttctggctgctcttgaacaacacgaagatctggtgactctaggcccagtctcccatcctcccttggtggagaggagtggcggccgctctgtgtacgtggggccgaggtgctttccagttcaccccagtctccaccactccctgtggcttggcgtctgctccacgcatcttacatcacctgcctggcccttgccggcatttgcgtctgagactcctgcgttagaaggatccggacgagggagatgtttgaccaggacagtgggagattagaggactctgggctgttccctcggggaatggcagcctctgagtcggagtctctgctgcttctgatctgtcctgttctccaaaagtgtaaccagtgaggagcatcgactctgggtccagaccaccagggcttgaatcccagctcacccacttactggctgtgtgatcatggcgagttccttgacgcctctggccttagcttcttcctgtgtcaaatgggc

SEQ ID NO: 294552 - DNA, 2696 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagcgagtgtaacagcaatcgagactcggtcctgtcctacaccagcgtgagaagtaacagctcctacttgggcagcgacgagatggggtctggtgagtggagtggcagcggcc

SEQ ID NO: 294553 - DNA, 1316 bp, Homo sapiens
tcgaatcgtaaccgttcgtacgagaatcgctgtcctctccttgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacaggtagcccctcccccagccttgcctgagccctgcctgagccctgcctgctccctggcactctctctgtttcatttaaatatatttttttcttttatcatgagatgtaatctacctacagaaaagtgcccagagcatagatgcatgaagcgaacatctgggtggttagcattcaagttaagaaataaaacactgcaccccaaatccttcctccttgcaatgccttcttccccctagaagtaaccactgtctgaattttgtgatgatcattttcttgctttttaaagacatttttacctcctaagcatttatgactaaacattttaattaaaatttctatttttgagcctta

SEQ ID NO: 294554 - DNA, 579 bp, Homo sapiens
  misc_feature (56)..(56): n is a, c, g, or t
atagggctcaagcgcccgcccgggcaggtccaccatgtaagaagtgcttttcgccntgcacaatgattctgagaaattccccagacatgggaactatattgatggagcagccactctatgctggacactgggaatctagcagtgaacaaaacaaattccctgccccagctgagctaacatcctaggcagggaatcaaacaatacggcctgggtgatgcatctcaactacccttcccccttgctgttccttgaacaagtggacacactcctacctccaagcctttgcacctgctgttcctgctgcccggaacacagattagacgactgaggcccagagaaataacgtgtcttggccaaggttaccctgccagttggatttggactgggatacaaatgcaagcccgcttcattccatggtccattatgttccagccatgttctcccctcgtggtagacagaattaatttaaagatgaggaaacggaggctcagaaaggtaccgtgaacagtttaaagtcacaaagcagagatactccagaggcctttattaggaataaaaatataaataaaaaaccagcta

SEQ ID NO: 294555 - DNA, 246 bp, Homo sapiens
caggaaagggccttcttcctcttcgacaaccttctcgtctactgcaagcggaaatccaggtgagtggccaggaggctgggatggggtctggcctgctgccttctccaggtgatgccttgggcttgtcacttccctctctgggcctccctttcctgtgagttgaggggtttgttctacatcagtgctgtctagtaggaatacaatgcaagccacgtgttatgttaaatgttctagtagccacattta

SEQ ID NO: 294556 - DNA, 597 bp, Homo sapiens
cctccccttttttctttcagggtgtgaggctttactgccgtcttcacagcctctacaccccggtgatcaagtaagttactctttccaagctccaatttcacctctacctcttctcagctgtgtggccttgggctggcaacttaacctctctgagctccagtctccttctccattaaatggggcttgcagtggcacctatcctttagatttgtcattaggattaactgaattaaattgtgggaagcactgcagtgtagtgatgcaggtgtcagttctggagccagacagactgagcttgaacctccctcctagttagcagctgtgtgaccttgggcagagttacttaacctctctgtgcctcaaccgtttcctctgtgaaatggggataataatgggctccaccttagggcctttgtgcctgctgttccctttgcttaggatgcctttcctctgcataccttcatattcgttccctcacttccttcaaacgcctccatatcacaggggtcttccctgcctacctgcataaagtgtcaccaacctggtactttctgtcctctgtattagtctgttttcatgctcctgataaagacatag

SEQ ID NO: 294557 - DNA, 3864 bp, Homo sapiens
  misc_feature (375)..(375): n is a, c, g, or t
  misc_feature (378)..(379): n is a, c, g, or t
  misc_feature (761)..(761): n is a, c, g, or t
  misc_feature (777)..(777): n is a, c, g, or t
  misc_feature (879)..(879): n is a, c, g, or t
  misc_feature (890)..(890): n is a, c, g, or t
taaaaaaagtcatatttgttatttgtctaatcttgtgtggagaaagacagcatgtaggaaagccactgggtgacattctggcaaattccatggttctgtcttgaagtgaagcctagtagtttttcaggaggtcctttgcaccacatcttgcattgtcattaacaattttatgtctctaaaaggtaatacgggttattttttaatgggtatggagtttccatttgggaagatgaaaagttctctaaatgcatgatggtgatggttgtacaaaagtatgaatgtacttatgccacttaattgtacatttaaaaagggttacaatgataaatattatgtatattttaccacaataaaaaagaaaaaaaattttaaaanaannaaaaaaggtaattatttcacctagacctatgtgtgtgagtgttgtcgctttgtgtgattttctgttggagttgaataacatgagctataacagaaaacatactgaggtttgtgaatgtgacataggaaggcagttctagtgtagcagttaaagatggtcaactctggagccagactgcttggcttcatgttctggttccattgctttcttgctgtctgaccttggataagtttcttagcctttcttggcctcagttttccaattgtgaagtagagataatgatcgtacttatttcatggaattactgtgaggattagatgagctattgttaaaaaaaaatacttaaaatggctgggcacagtggctcacgcatgtaatcccngcactttgggagaccnaggtgggcagatcacctgaggtcaggagttagagaccagcctggccaacatggtgaaacccatctctactaaaaatacaaaaattagccaggcgtggtggcnggtgcctgtantcccagctacttgggaggctgaggcaggagaatcacttgaacccaggaggtggaggttgcagtgagctgagactgtgccactgcactccagcctggacaacagagcaaaaatccatctcaaaaaaaaaaaaaaaaaaaaaagcttaaaacatgttctgtcatatggtaagcgctaaatgaatggacccctagacctgggttctaaacagtgttactgatataaatacacttgcgaatgtaaacataaatcggacatttgtttttgctttttttttaaaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294558 - DNA, 814 bp, Homo sapiens
agaatatcagctctttggagggtgggtatttgcctcattcagtgttttatcttcaacacctagagcagtgcctgacatagcagaagctcacatgaaaacggactaatacgcagctataagccaagaaatactgacagccaccagcaggtggaagagatcaagatgggattctgctgtagagtctctagagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccaggtatgattcatagttatactgt

SEQ ID NO: 294559 - DNA, 808 bp, Homo sapiens
gcaggaaatgaactgagcaaggcaggggcacttgcttgtgggatggctcagtgccaaggcccgatctccttctgcagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgcttttttctgtcaccttttcaaaaaaagggggcggaaaccttgggggggggggggtggggggggtttttcccccaaaaggggggagaaaaaaaggggggccccccaaaaaaggggggtttttgtgggggggggccccccaaaaaaaaacgaaacaccccccattttttttttttcccccccccgcccgggggtgggtggggggttattttccaccccgattttttcccacccaaaacgaggagggggaatattatattatgtctgctaccaccaccccaagtgattttgtgtgtttcgcccccaccacgagcaaacgacggggggggcgcaacaacaaaaacgcagggccggggccaaccaacaaacagcgggacgggggcggcggaacacaccaccactagctatgtctttgttgtcgtctccac

SEQ ID NO: 294560 - DNA, 4033 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294561 - DNA, 3811 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294562 - DNA, 2186 bp, Homo sapiens
  misc_feature (50)..(51): n is a, c, g, or t
  misc_feature (59)..(59): n is a, c, g, or t
ctaggacggccagatgtatgggcattgctagatgggctgtgagatgaacnntccaaaanaaataatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294563 - DNA, 1181 bp, Homo sapiens
ggtttcaccatgttggccaggttggtctcaaactcctgacctcaggtgatctgcccgcctcggcctcccaaagtgctgggattacaggcgtgagccactgcgcccggctagatttttatagttattatttgttgtttttttgtttgtttatttttctagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294564 - DNA, 970 bp, Homo sapiens
cccgggctgcaggaattcggcaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 294565 - DNA, 1319 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaacttgtataaaatggatactgtaattcatgtttaagtaaccagtaaaatgtacagaatgccctttttatatggtaaattagaggttgcaaatctgtgcagaacatttctagaaaataaagttttttaaaaattttg

SEQ ID NO: 294566 - DNA, 2087 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggatccagtttggcccagtggtctttctcttgaggatctagagttatattcaaagccctattcccttcttccctaaaaaagtcattatgcttcatatttaagttttaagctaatgtttattgaaatgcatttttgtgtgatggaactaaatcttaggaattaaaaaaatatgaaatca

SEQ ID NO: 294567 - DNA, 2311 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgtggtcactcacctgtctaccactcccgtgaaatggcagctcgtgccttggtcccatttgttatgatagatcacattcctaataccattcgaactctgttgtccacactccccagctgcaccccatattggctgcacccgggtgcagccaatatgcagccaagctcaaaccagaaaataaatttattatgtgacaaaaatgaagaagaaatttaaagtgagggagtgaacagaaattgaagctgtgtggctttgcagttgggggattaaggctctaatcatgagtgtgaggtgaattctaggccacagggcacaaatgtgcagagaattagaattgagctacctgcttaaagctgggagtcacaaaggacatctctgtgtgtaaaataggaactagaaagatgtcacccactggctaatgaaaatgttaagaagaatcaggggttacttacaagaagtcagaaccacagtcctgtaccacatgtaggagtg

SEQ ID NO: 294568 - DNA, 1012 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaagtaaggatttccacagctgcctcctgtctcagaaatccattcatttctgagctttaacctctggttggaatgtgtcctgggaaaggaatgcagtctattgctttgaataaaattgaaaatcagattta

SEQ ID NO: 294569 - DNA, 1202 bp, Homo sapiens
  misc_feature (282)..(282): n is a, c, g, or t
  misc_feature (531)..(531): n is a, c, g, or t
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgnaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacantttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcaggttagcaaatgaagaaggccggctagagtgctgtggtttgattattatgtctttacctctttttttttttccccaagtatttctttggggagatataaaagctaagttgaggagaaaataattattattatttgtggtatttctgccttttagcaatagttttaactattaaaaagtagca

SEQ ID NO: 294570 - DNA, 299 bp, Homo sapiens
gactctagagatccccttgaaatgggcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttctgtgcccatttcaacctaggggatcccctagg

SEQ ID NO: 294571 - DNA, 577 bp, Homo sapiens
gactctagagatccccttgaaatgggcacagaaattgtttccatggaagaaatgcagtggattcagttctttattacatacaatcttaacagccagtctccaggagtgcggcaacagatctgttctcttcttaaaaaggtagaatttcccatcagaaggcatagggaagtggtgaactttgtttgggaaatcgtttttaaaaagagcccagattttgggagcgtgtgggaatggtcatggaattgggctaccacatctgttcatgacggccgttctgtgacctgttctctcattccataaagcttacatttgggattaaaatccagagtgaaaagcacgcacccctccccccaccattttttttcaggagttcagaatcagcctgggcaacacagtcaaaccccatctctactaaaatacaaaaaaattagccggttgtggcagtgtgtgcctgtagtcctagctatttgggaggctgaagcaggagaattgcttgaacctaggagcggaggttgcagtgagccgagattgtaccactgcactccagcctgggcaacagagtgagactcggtctcca

SEQ ID NO: 294572 - DNA, 491 bp, Homo sapiens
caagagatctgctttccaaggaaagggcaaaccagtcaaatccaggcagatgtgcagaggagacactggacagggaagccttcctgatccttctggtgacactggaggagcagaggggagataactctctaatcctgcagatggaactgcttctgtccacactgagttagggggcatggaaacagtgggttcaggcctatgactcattctaacagtataaatagcaggattcagaaggtgattaatcgtctccagtgagcccaccctaccagcttccctgccaggctggtggcagcgattttacctgaggcctttattgttcccagggtcctgcaggctgccctggggtcggccctgagcagtatattcattgctcacctttctcctgtctttgcagagtttgccttctgccaggtggatgcctccatcgctctggccctggccctggccgtcctgtgtgatctgctccagcagtgggaccagttggcccc

SEQ ID NO: 294573 - DNA, 545 bp, Homo sapiens
accacaaacacatctttatccaaggtcatgttaagtctggggaaaaaattcctctctggtggagaaatacagtgagtgaaaatagaaggtgaccttcaaggctgcaagtggtgtgtgtacatggatgttgacaggcaagagtgcaccctctgtcaggtgggggaagggaaacccctcttgcatctggcagggtactgcttggtctggactggggcttgtcaccattccctgtaagactgactttcggctttttcatctgatttaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttga

SEQ ID NO: 294574 - DNA, 2641 bp, Homo sapiens
  misc_feature (2254)..(2254): n is a, c, g, or t
agacaaaaaattagggcataagggatagcgaagtgcaccctgagagggggggttttaatatcggacgaggccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatagaagggctctgatttgcacaatttgttgaaaaatcacaaacccatagaaaagtnagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagc

SEQ ID NO: 294575 - DNA, 2109 bp, Homo sapiens
  misc_feature (3)..(3): n is a, c, g, or t
  misc_feature (26)..(27): n is a, c, g, or t
ggngcgagaagagacgcttggcgganntccgcagttgggaggagggggcgggaagcagtttgaggggaatgtctgagaggcgctgcccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatag

SEQ ID NO: 294576 - DNA, 772 bp, Homo sapiens
gtctttaaaccgtttatttctccccaccagaagttgggtggcagggcctagaacacagcgtgcgcgggttcccgggtggagccagcgcagacagcgtgggtccctgcggctcttaggcgaaggtggagttgttcccgcccacattggccgcgttcatgtcgtaatagttgatgtagaccctgtccgggctgatgcgcaggcgctcggccagcaggccgcacagcagcttgctgtaggagcggttctgcgcgccgccgatcttgccgatgctgtgcaggctgcagagcgcgcacggctcgctggagccgccgaaggccatgagctggtccgggaccacgtgcaccgcgatgtactgggggggcttgccggtggcctgcgccagctgctgggtgagctcggagaggaacccgtccggcacggaggcgcggggcacgttggtgtttacgatgaacatcggcatgatggcagaaggaccagggccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcaatcacaggccgccctctgcattccc

SEQ ID NO: 294577 - DNA, 4087 bp, Homo sapiens
  misc_feature (2209)..(2209): n is a, c, g, or t
agcggagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatagaagggctctgatttgcacaatttgttgaaaaatcacaaacccatagaaaagtnagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 294578 - DNA, 4132 bp, Homo sapiens
  misc_feature (2254)..(2254): n is a, c, g, or t
agacaaaaaattagggcataagggatagcgaagtgcaccctgagagggggggttttaatatcggacgaggccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatagaagggctctgatttgcacaatttgttgaaaaatcacaaacccatagaaaagtnagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 294579 - DNA, 812 bp, Homo sapiens
agcggagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaaagcctcgcgcgtctcaaggccaggccaatcatgaaattcccgtaattcttccgcccaacatacagggccaactctagcccaaactcaaggggcgatgcccgctgcagcggggccaagttccaggcgcgtcgcgggagccggcggtcgccccgcgcgg

SEQ ID NO: 294580 - DNA, 4382 bp, Homo sapiens
  misc_feature (166)..(166): n is a, c, g, or t
  misc_feature (2504)..(2504): n is a, c, g, or t
gaacgggtgatgcggttgtcacggttcagtttgaaggcatgcataagaatgaagccataagccaacagcttcatgttttacggaaggaagtgaagcagttgcaagcgagaagcgtgctaaacgcaccactcacttacatattggtggaagcgtgctgtacatgcangcaaacttgatcacggcgcttagtgaatgcctacaagttgcagcctacacctgggattcagaaagttggcattagccttttctttactattgtggattacgtcagcgatgagacgcagcgtcatcccccaacaaggcagttctttacttcatgtattgagatcatggggcagatctacaccggcctgaagagtgcaggcaggaggctggcccagtgcgcctctgtcaccatcaggacaaacaagctgctgccaatgcaagtggatggagaaccctggatgcagccatgttgcacggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatagaagggctctgatttgcacaatttgttgaaaaatcacaaacccatagaaaagtnagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 294581 - DNA, 936 bp, Homo sapiens
agacaaaaaattagggcataagggatagcgaagtgcaccctgagagggggggttttaatatcggacgaggccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataaccaaaaatgtcctgtttccccttatcctgattgcgtgatccagtgtgagcagcccttcatgataaaatccactgtggttgatgtaaggtcacagtagaggaagccgccctgtcatctctaatgagttgggagaacaagggtttccttagacctctttctcaatcttgaaaataaaaccaatagttgtctatcataaacacaaccaccatcacataccaatcaaaaaccaccacacaacaacaagatagaaaacacaaatagaggcgcgcggagtcatattatacggggcgcgagcacaagacagatgtagcgagagagaaggagcatgtctctgttctgttctgtacgccgacgacctgtagttgggaacaagaggtgggttacttgcggggggacccccaagtagggagggcgagtaatg

SEQ ID NO: 294582 - DNA, 2884 bp, Homo sapiens
  misc_feature (1006)..(1006): n is a, c, g, or t
agacaaaaaattagggcataagggatagcgaagtgcaccctgagagggggggttttaatatcggacgaggccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctgcatcgatcatggactactaaatgcctttacatagaagggctctgatttgcacaatttgttgaaaaatcacaaacccatagaaaagtnagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 294583 - DNA, 985 bp, Homo sapiens
ctgccaaagcagccaaccaaaggggcagctcagctccttcgtggcaccagcagtgttcctgatgcagttgaagagttgatgtctttgacaacatacggacactgcctggattacctagatgtcacatcttaattgccaattgatgaaattaggtaaatgaaaagaaagcacttaaatttccccttagagcattttaacatgacatgcaatcaggttttgtctgctaataattatttctccccctccatccctcccaccagtttctttcctgaagtctgtgaggccgctataaacaggtagatgaagttagagcagttatggccctaaatggtccacagttgggtattggcactaccgcagtttcaggtgatgtcggcatttttagaaataggaggagatggaaaaattacgcttcagctgttaaaaatatttttggggcattgagttactttaaaacacgtatattctctaagctgtttttatctgaacttgtagagtctattcattttcttgttcagaacattttgtaatatgtgaaaccttttataattaaaactctgaactgcagattaagtctgacttgcagttttgtaagattctaatggattaacagcattttgttttgcgattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294584 - DNA, 1869 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgggtctcactctgtcactcaggctggagtatagtggcatgatcacagctcactgcggcctcgacctcctgggctcagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294585 - DNA, 1130 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaa

SEQ ID NO: 294586 - DNA, 742 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactgcagatgctctgtgtgatttgtaatctgaagtgataactggccagtgactgtcaggttctctgtcgtaacaccagcccagtgaacatgccagcctgcttccttctctctcttctgtacacagcacattttactccaggactttcacggtggctgtgtgagagtagaagtcggattctttcattcccata

SEQ ID NO: 294587 - DNA, 803 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactgcagatgctctgtgtgatttgtaatctgaagtgataactggccagtgactgtcaggttctctgtcgtaacaccagcccagtgaacatgccagcctgcttccttctctctcttctgtacacagcacattttactccaggactttcacggtggctgtgtgagagtagaagtcggattctttcattcccata

SEQ ID NO: 294588 - DNA, 497 bp, Homo sapiens
atagtgtatatattgtacatttgtttccaaaaggggaaagaaataataataaaaatatatgtatgttttttacacacatatttgtttttatttccatagaatatttctagaaagagacacaagaagcctcatgccagttgcctctggagaaggggactggtggtagctggggggcaggacaagaattggagggggatttactcattatctttttgtgctttttgaattttgaatctcatgaatgtattctttttgaaaaataatttaaaacattgtaggccaggcgtactggttcacacctgtaatcccagcactctgggaggccgaggcgagaggatcacttgaggtgaggagtttgagaccagtctgggcaacacggtgaaaccttgtctctactaaaaaaacaaaacaaacaacaacaaaattgtatatctgtgttgtaacttattttacagttttacctagattaaaactttttagttgccattggaaaattg

SEQ ID NO: 294589 - DNA, 948 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaa

SEQ ID NO: 294590 - DNA, 635 bp, Homo sapiens
ctgttggttgttgtgtttgcagtatggggttcctctgcagacttcagattcgtttctgagatttccttcgtccctgacatcatctctgtgcactgataataaccctgcaggtaagaaagtggtcattcttctttccttagacatttgctgttattattaggttggtggaaaagtagttgcggtttttgccattaaaagtaatgaccaaaatcgcaattatttttgcaccaacttaatactttacatttgtagtagtcatcattaaacaggcctcgtaactaaaaacagaatcttcgggttaaaagaggcctcaaaggtcacgtagttcaatttctcacccagggccagtcttttctaccacatgcagtcactgcttgagcacttgtagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtg

SEQ ID NO: 294591 - DNA, 319 bp, Homo sapiens
  misc_feature (307)..(308): n is a, c, g, or t
  misc_feature (312)..(312): n is a, c, g, or t
cagcttcattccaacagatcaatgaccacctgttagcacttcccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgcaggaagcaagccggggannctcnagagccc

SEQ ID NO: 294592 - DNA, 1934 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294593 - DNA, 1880 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcagccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294594 - DNA, 2511 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagaaggtaaaagagtcacttgtttctgtttgaacttgtgctgatcagaaaacaaagcattctcacttttccccattttaatcaaatctctgcatcagctgatgagctcacatgaaagccacatatagtatatcatcatgcatgaatagtagcaaaactgttacaatcatttttgttattaaatacggcaaagcaaaaatttcaaggctttgtatgtttctttttctttttttaagagatggggtctcgctcttgtactccagcctgggcaacagagcaaactccatctcaaaacaaaacaaaaaaaccaaaaatcaaaacttaaaaaacaaaaaactgctggtgggctgggtgtggtggctcactcctgtagtcccagcactctgggaggattgcatgagcccaggagtttgaggctgcagggagctatgatggtgccactgcactccagcttgggcatcagagtgagaccttatctcaaaaataaataaacaaagggaaggaaaggaagaagaaaatgaaaaactgctggtggatgaacaacagcctcattcagttgacttctttttccttcaccaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294595 - DNA, 1793 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294596 - DNA, 1581 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294597 - DNA, 2002 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294598 - DNA, 1890 bp, Homo sapiens
cggctgcacgcgcctgtcatgtgcggctcgtgatcctggaaatagcgcaagtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294599 - DNA, 1892 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294600 - DNA, 1879 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaatggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294601 - DNA, 1824 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294602 - DNA, 970 bp, Homo sapiens
  misc_feature (29)..(29): n is a, c, g, or t
gggaagaaaagttattgggtggagggaantgtgttgaagggtgaagagtttagggtttgggtaaatgttgttgttgaggtaaaggagagggtaaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294603 - DNA, 789 bp, Homo sapiens
tgaagcctttaataagatgaatatactcttcaactcgagatctgaaaaagcaatgaaaatacttctttttgttgtacttaacacaattttttgtggtttctttttatctaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294604 - DNA, 2112 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaaccttataaataattaatctataaatatgtttgttaccatcttaaactctgataaacgttttataagtttaggttgttctgcacttcgctctataaataatcaaaccccgggggggggcccggtcccccattcccccctaatagggggggattatacaattcattggcccgtggttttt

SEQ ID NO: 294605 - DNA, 2369 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaagcaattgtccagctttgttgctcattttcaattaaggctaaagtgttcaacatgagaaaatgtgatacatttgatacagtgtggggtgggagtggatgggcagctcttggtggtactggaccttccacaaggctgtgtccacccagaatccatgctggcaggagggaggcagaggtatcaaaccaaacctctcaccaagcggcccaggaggggcagctgttcctctcgtgacagcacaggcccatgagacagtgtcttctttttgaggggagctggtccgggtctagttcacttcaccaagaagtccatgctgtcgcaatagtttgttaagtctttcaatttcttgttccttctcagagcagctgaactcaaggtgttgaatcttggcggccaattgtacattcatctgttttaaccttaagagttgccgttctg

SEQ ID NO: 294606 - DNA, 1418 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294607 - DNA, 1645 bp, Homo sapiens
  misc_feature (1633)..(1634): n is a, c, g, or t
  misc_feature (1638)..(1638): n is a, c, g, or t
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgcaggaagcaagccggggannctcnagagccc

SEQ ID NO: 294608 - DNA, 1898 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294609 - DNA, 1535 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294610 - DNA, 784 bp, Homo sapiens
tgtcacacaagtgacactgtcttcttacctgagaaccaggctgctctagcactaggcagttgtcccttaactgtctgtgaatgtctgggattattcagaccacaaatagatatggacagcttactattcttcatagcacaactgagcaagactgcttagcactggagggggtccggaccccagtattatttggttacactatgcaatctggctgtaaactaagaaggtaaaagagtcacttgtttctgtttgaacttgtgctgatcagaaaacaaagcattctcagtggaaaccctggttatgtcgtggggctcccattagctgctggattccagcctcataagggatatcctttttgggttctgtagagggtggatttatttctctctccatccacttcatcacccaggtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294611 - DNA, 504 bp, Homo sapiens
  misc_feature (24)..(24): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (98)..(98): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (127)..(128): n is a, c, g, or t
  misc_feature (136)..(139): n is a, c, g, or t
  misc_feature (141)..(145): n is a, c, g, or t
gagcctaacatagtagggagacanaggcttcacacaagattaacgtggccacctatttagagaaaatananangcccaggncaaaanagnctgggtgncnatccncnacntnanccngtaatacgannggaggggnnnntnnnnngattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaa

SEQ ID NO: 294612 - DNA, 1318 bp, Homo sapiens
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggtaagaaagtggtcattcttctttccttagacatttgctgttattattaggttggtggaaaagtagttgcggtttttgccattaaaagtaatgaccaaaatcgcaattatttttgcaccaacttaatactttacatttgtagtagtcatcattaaacaggcctcgtaactaaaaacagaatcttcgggttaaaagaggcctcaaaggtcacgtagttcaatttctcacccagggccagtcttttctaccacatgcagtcactgcttgagcacttgtagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtg

SEQ ID NO: 294613 - DNA, 880 bp, Homo sapiens
aattgccatttctgcaccaggcactgtagctagcttgctctccgactggcaggctggtatgggtgccacagaggaaagaatacagtaggagggtccagggaaaagagagagtttattttatacagtagttgttttattttatacagtagttgtacagtaattgaggaaaaatgttgtcaggtggcagaaaacaatggagccacctagaagctggctgatgcagctggggcacacagaggaggggcctgggtaccccttttggggaaactgagacgaagctatttagaacagcttgaaaataagagacttttctagaatggggtggcagctaaagtagcttctttttctttctttcagaatgctcagatgcatcagttccttaatatacacgtgaaatttgaaaactgtacattcggtgagattaaattttatatacaactagcaagcaattgtccagctttgttgctcattttcaattaaggctaaagtgttcaacatgagaaaatgtgatacatttgatacagtgtggggtgggagtggatgggcagctcttggtggtactggaccttccacaaggctgtgtccacccagaatccatgctggcaggagggaggcagaggtatcaaaccaaacctctcaccaagcggcccaggaggggcagctgttcctctcgtgacagcacaggcccatgagacagtgtcttctttttgaggggagctggtccgggtctagttcacttcaccaagaagtccatgctgtcgcaatagtttgttaagtctttcaatttcttgttccttctcagagcagctgaactcaaggtgttgaatcttggcggccaattgtacattcatctgttttaaccttaagagttgccgttctg

SEQ ID NO: 294614 - DNA, 153 bp, Homo sapiens
catgctttcataaatatcctccacgtaactgttaacatagtacagtacaagcatctgacagttttaaaataattttgctaagattgtgtgcttatgtcttgtaactttgtattattatttttttaattttcaggggcgacagccagttttgta

SEQ ID NO: 294615 - DNA, 2530 bp, Homo sapiens
gaaccttgcaaaggacacttagatctagggctctgaagccatataagtctaagtcatgccttgtcttttaatatcgtgttccttaggtaacaattcctgtgcttcctattcatattgtatcgtgttgaatctcatgtataccactattaagaatatcccgatctgttgaacctgagcacgtttcatgtagtcaatcttccaaatgtggaagttacttgagcgcacgctacatggagaagctatagtaaacgtgatagttccaaactaagaatcaatttgctaattgataccaaggaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgatgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttca

SEQ ID NO: 294616 - DNA, 1212 bp, Homo sapiens
gaaccttgcaaaggacacttagatctagggctctgaagccatataagtctaagtcatgccttgtcttttaatatcgtgttccttaggtaacaattcctgtgcttcctattcatattgtatcgtgttgaatctcatgtataccactattaagaatatcccgatctgttgaacctgagcacgtttcatgtagtcaatcttccaaatgtggaagttacttgagcgcacgctacatggagaagctatagtaaacgtgatagttccaaactaagaatcaatttgctaattgataccaaggaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagag

SEQ ID NO: 294617 - DNA, 607 bp, Homo sapiens
atgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatg

SEQ ID NO: 294618 - DNA, 767 bp, Homo sapiens
catccctcagtccaggaagtacttacatttccttcttttttgaaaaatcaagttcacaactatgctaggaagtacagaaaaacagggaagatgtgattacctgctggctggaagagacaggcataagatgcaagggagcctggtgtggggagaattatgctacgaaaaggggtaagccaaagcccagcaccattttgcaaccctaaatatggatctaggcaatggccatcaacagacgctaaaacctcaagatggaggagcagtggaaacctatcagggaagaggcaggctgccaccactggggcccctcatccatcctcccatcagcaaaggtggggccaccagacctcacacgcctcctgaaggcatctaagaggaggttcacagtgccacatgcaggcatctctgccacacgcagctcagccgggatctaattgagcggttggactcatcgccagcttacggcaagtgcacgaaacacaggcacaggttaaacaccgctgtgagcaagcaatgaggcaaatacatcatatggactattcgacaggacaaatgacctggctgctccaataaatcaatgtcatgaaaaaaagcgtggggtggagcctgttctagaatgaaacagttaacacacataagcagttgcaatgcctggatcctaattcaagcaaatcgatcataagaagttatctttgagataaatggagaaatccaaatgcggactggagacttaggtgacattaagtattcatttttttatgagtgat

SEQ ID NO: 294619 - DNA, 376 bp, Homo sapiens
ttttacaaataataaatttatttccaaatcctgaattataaccaaattacaattccctttaggtcttttttgctgctttacacaaggattaaaaaagacagccacagccaagtcacgcatacaccaagtgtcctgggccagttttagatgcgatgggacaaatgacctggctgctccaataaatcaatgtcatgaaaaaaagcgtggggtggagcctgttctagaatgaaacagttaacacacataagcagttgcaatgcctggatcctaattcaagcaaatcgatcataagaagttatctttgagataaatggagaaatccaaatgcggactggagacttaggtgacattaagtattcatttttttatgagtgat

SEQ ID NO: 294620 - DNA, 407 bp, Homo sapiens
cccccaccccccaccaggcaggggtcgcgggagatggcgggcgcctttctggtggctccacgtcctccttactcccgaagtcccggcggccccgagtctgccccaactccagcatccgttctccccgagctgcggcggggaaaacaagatctgctctccgcagacagtgggctgccggcggtggaccagggagaggtggcgggaccccggctgcagcccgctcagccgctccgcccgggcgccgtccccagcgcctcccgcgcccgagctccagacacaaaggcggggacacgagcccgggaccccgcgccgggagcctcccaactccgtgccgcgcactcaccccatcgaggcggcggcggcgctccccggacccagctggctgctccaccccgcccgccgcttcc

SEQ ID NO: 294621 - DNA, 702 bp, Homo sapiens
ataataattcttttttagaaatatgtgcttaaataattgtaagccaggcatagttgcctgtgcctgtattcctaaccacttgggaagctgaggcaggactgcttgagcccaggggtgtgaggctgcagtaagctatgatcacgccactgaactccagcctgggtgacagtgagaccgtgtttaaaaatatatatatacagatgaaatgatatgatgtctgagatttgcttccaaatatgcctaggaagggaagaagtgtttagagatatagacaaatcaagattgtcaaaatgtatagtaactgttaaagcttgctaaggtagttattctatttttggatatgtttggaattgtcccaaaggtttccctaaaacttatgttttaatattctttcaggagaaagcaatattgtaagatcaaagaaaaggccataacagcgcacccaaaaaatttcagccattctgagggtcaggagtctcctcccttccatccgccaacacttgaatcaggactataaagtaggtgtttccaagtctcaggcaggtaaatggataaattgcaaaactggatgcagaactcacatctgcctcatacataggccctgtgacaccccaccagctcctttgctccctttctgcctttctcatgccgtcccagagtcttgcacactaccaagatggtggtgagtcaggacagtgaaac

SEQ ID NO: 294622 - DNA, 1441 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294623 - DNA, 1462 bp, Homo sapiens
  misc_feature (866)..(866): n is a, c, g, or t
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattagggatcattgcagagcaggtgactgacatttgaaggctgtctgaaaagagtgttgtacgacagagcttttggggggtgtctgggaacagaaagggggggtgatagacaggagaggtttcccacaagtgggtggtgttcttnttcttttcttttttttttttttttttttttttttttttttttttttttttttcaaatattcagggaactttatttttaaagaataaatcaagtaagacacagctttcgtttacctaaacatgcataatccaacctgaatataaactgcacttaattggtgaattacacatgaaatacaaagggaatgcaattttacatatgtaaaatgattgctagctatagcaatttaacagtcaaatttatcagaacattgtacattaaaaaacacaaacaacaacttaaagccaaatatctatagtaaaccaaggaaaattctgatatggaatggtttgactaaaagcaaagaataaggcacctgctatgaatttagcacaaccataaaacagaattagttaaccaagacacttgtttcaaaaagggaaacaagtacagagactgattaactgggtgagaaaggcaagtaacaatttagttaaaaacctgctggcccaaggtcagttgattcattccttattccagaatagttaagttcctgaaagtcctaaccactctgctcccttactgttcatcatattgaatgcgggccgagctcgatc

SEQ ID NO: 294624 - DNA, 617 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacacagggtgccattttgagattaaaccttttaacattgatggtaaccatgatggttgggtcttaaagcttggaaaattc

SEQ ID NO: 294625 - DNA, 441 bp, Homo sapiens
gggcgaatggggtacgggccccccctcgaaggtcgccggatcgagattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294626 - DNA, 1024 bp, Homo sapiens
acttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgtgcattgatcatggtttctaggccttttttttctatttaaaagatgtaacaatcataatttttttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatctcattctgagggtcaggagtctcctcccttccatccgccaacacttgaatcaggactataaagtaggtgtttccaagtctcaggcaggtaaatggataaattgcaaaactggatgcagaactcacatctgcctcatacataggccctgtgacaccccaccagctcctttgctccctttctgcctttctcatgccgtcccagagtcttgcacactaccaagatggtggtgagtcaggacagtgaaac

SEQ ID NO: 294627 - DNA, 1124 bp, Homo sapiens
acttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgtgcattgatcatggtttctaggccttttttttctatttaaaagatgtaacaatcataatttttttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatctctgtaatcccagctactcaggaggctgaggcaggagacttgtttgaacctgggaggcagaggttgcattgagccgagaccgtgccactaaactccagacccattctgagggtcaggagtctcctcccttccatccgccaacacttgaatcaggactataaagtaggtgtttccaagtctcaggcaggtaaatggataaattgcaaaactggatgcagaactcacatctgcctcatacataggccctgtgacaccccaccagctcctttgctccctttctgcctttctcatgccgtcccagagtcttgcacactaccaagatggtggtgagtcaggacagtgaaac

SEQ ID NO: 294628 - DNA, 839 bp, Homo sapiens
  misc_feature (816)..(816): n is a, c, g, or t
acttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgtgcattgatcatggtttctaggccttttttttctatttaaaagatgtaacaatcataatttttttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatcttatttagctcttgtcttggtcttattaaatgatggtngaccatatataagtactctttat

SEQ ID NO: 294629 - DNA, 578 bp, Homo sapiens
gtatatcacgttgtgagcgatactggtccttggttctcgtttggtttcacatcggtacccgcgcgagttgggcattgtatgccctgtgttgtcggcgccgggcagtggcagagtcaggtatgtatgtgtacttggcatttgttattctttccgtgctggtgtttgtactggctgcgcctgtcgctgtgcgcctcgttttctggtgcttagctgcgctttcgttggtcgctagtcgtcctcgtttgtgacgcatgtcgcaatgtcagacgggactcacctctgtgtgacacgtttggtgtgcgtgcttttgaattagccattgatctcctttatcattctgagggtcaggagtctcctcccttccatccgccaacacttgaatcaggactataaagtaggtgtttccaagtctcaggcaggtaaatggataaattgcaaaactggatgcagaactcacatctgcctcatacataggccctgtgacaccccaccagctcctttgctccctttctgcctttctcatgccgtcccagagtcttgcacactaccaagatggtggtgagtcaggacagtgaaac

SEQ ID NO: 294630 - DNA, 625 bp, Homo sapiens
  misc_feature (359)..(359): n is a, c, g, or t
  misc_feature (361)..(361): n is a, c, g, or t
  misc_feature (372)..(372): n is a, c, g, or t
  misc_feature (383)..(383): n is a, c, g, or t
ctaatttggccatgtccagtttatacagtttacataatcttgcatctgctatatttgtaaactgtataaactggacatggccaaattagagatgtctgataaactttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaaaaaaaaaananaaaaaaaaaanaaaaaaaaaanaaaaaaaaaaaaaaaaaaaaaaaaaaaaaaaaaaaaaaaaaaaaaaattaactggccgtcgtttaaaaacgtcggaactggaaaaaccttggggtaaccaaactaaatcgcttggaagaaaatccccttttcgcaagttggcgtaatagcaaaaaggcccgaaccgatcgcctttccaaacagttgcccagcctgaatggcaaatggcaaattgaaagcgtaaattttggtttcgcgttttt

SEQ ID NO: 294631 - DNA, 277 bp, Homo sapiens
ataataattcttttttagaaatatgtgcttaaataattgtaagccaggcatagttgcctgtgcctgtattcctaaccacttgggaagtgaatactttttgtattttttgtagagacagggtttcatcatgttgcccaagctggtcttgaactcctagactcaagtgatcctcccctcctcggtatcccaaagcgctgggattacaggcatgagctaccgctcctggcctatttggtactttttttaaagatggggtcttgctctgtcacccaggctt

SEQ ID NO: 294632 - DNA, 3502 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294633 - DNA, 3602 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgatttgaaaggaactcctactttgtggaattaaatctacattagagcactttatatggtaactatactcacaaaattttgcattataaaagttattatcatt

SEQ ID NO: 294634 - DNA, 3778 bp, Homo sapiens
  misc_feature (3512)..(3512): n is a, c, g, or t
  misc_feature (3514)..(3514): n is a, c, g, or t
  misc_feature (3525)..(3525): n is a, c, g, or t
  misc_feature (3536)..(3536): n is a, c, g, or t
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgaaaaaaaaaananaaaaaaaaaanaaaaaaaaaanaaaaaaaaaaaaaaaaaaaaaaaaaaaaaaaaaaaaaaaaaaaaaaattaactggccgtcgtttaaaaacgtcggaactggaaaaaccttggggtaaccaaactaaatcgcttggaagaaaatccccttttcgcaagttggcgtaatagcaaaaaggcccgaaccgatcgcctttccaaacagttgcccagcctgaatggcaaatggcaaattgaaagcgtaaattttggtttcgcgttttt

SEQ ID NO: 294635 - DNA, 1485 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaaaaaaacggaaaaaaaattttgggggtctggcaggaaatttaaa

SEQ ID NO: 294636 - DNA, 1572 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaatagttaaaaaaaaaaaaaaaaaaatttggggcgggccggaaattttaacattttggggggcccaagaataatgcccggcagagaaccgcgaaggggttccaaaaacgggggggtgaacaggtggtgtaagc

SEQ ID NO: 294637 - DNA, 1920 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaaaaacacaaacaaaaacaaaccaaacacacaacaacctggtgctggcgccgcctggcgcccgagaaaaaaggttcacgaaacccatcggtgggggcgcgcggcggccccaaatggtaatgcgccacccggggccaacgggggttccaaaaggaacccggggtctaaaccacaggcgcgggcatcttccccccaatataaaaaacgccggggggggacaccgacggtgtctcgcacacaacccagagggaggcctgcgcggggccactacggcggcattacaacgggaccaagagagccgaataaaataaccgccacggcggggggtgcacacaaacacacacaccacaccaaagaagaaaacacagacaaacaagaagaaccaacaaacagaacacaaaaaagaaagaaacacacaaagcaaaaaaatagaacacaacagaacacaaacaacaaacaaatcaacaagataaaaagcagc

SEQ ID NO: 294638 - DNA, 1417 bp, Homo sapiens
  misc_feature (24)..(24): n is a, c, g, or t
ccagttgatacgcccccgagtatntccctatcgtggaccaggcctcggagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294639 - DNA, 959 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccaagtcccccccagagagaacgtcggtacgagcta

SEQ ID NO: 294640 - DNA, 2042 bp, Homo sapiens
acttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgtgcattgatcatggtttctaggccttttttttctatttaaaagatgtaacaatcataatttttttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatctcattctgagggtcaggagtctcctcccttccatccgccaacacttgaatcaggactataaatgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294641 - DNA, 1628 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttggtgagtatgtgcactgggccccggccaccccgccgcgcctctgctcggcgccattggctacgcgaggccccggcttcgcggcctaaatggccgcatcttcgctggcctcgtagaactgtgccggcgcccttccacagccagccttctcgcggccccttagcgcggtcaggccgccctccttttccagtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294642 - DNA, 1660 bp, Homo sapiens
  misc_feature (384)..(384): n is a, c, g, or t
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgagatggagtctcactgtattgcctaggctggtcttgaactcctgggatcaagtgaacctcctgcctcagcctcccaaagtgctgggattacagatgtgagccacgatgcccagcctatgatagactttaaaaagcacaaaaccantttgaaatagcatggacaagagatttgctgtattttcgaaatttcctttctgttctgcatagatcatctaatattgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294643 - DNA, 1536 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgagatggagtctcactgtattgcctaggctggtcttgaactcctgggatcaagtgaacctcctgcctcagcctcccaaagtgctgggattacagattgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294644 - DNA, 1720 bp, Homo sapiens
ataataattcttttttagaaatatgtgcttaaataattgtaagccaggcatagttgcctgtgcctgtattcctaaccacttgggaagctgaggcaggactgcttgagcccaggggtgtgaggctgcagtaagctatgatcacgccactgaactccagcctgggtgacagtgagaccgtgtttaaaaatatatatatacagatgaaatgatatgatgtctgagatttgcttccaaatatgcctaggaagggaagaagtgtttagagatatagacaaatcaagattgtcaaaatgtatagtaactgttaaagcttgctaaggtagttattctatttttggatatgtttggaattgtcccaaaggtttccctaaaacttatgttttaatattctttcaggagaaagcaatattgtaagatcaaagaaaaggccataacagcgcacccaaaaaatttcagccattctgagggtcaggagtctcctcccttccatccgccaacacttgaatcaggactataaatgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294645 - DNA, 1235 bp, Homo sapiens
gcaagcgcacagtcgtcaaaaaaccaacaaacctgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294646 - DNA, 1242 bp, Homo sapiens
gcggccccgtggcgtactgcatctttaatctcttgctgggtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294647 - DNA, 1396 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagatttgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294648 - DNA, 1396 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294649 - DNA, 1466 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgggggcggtgccatttatttttatagatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294650 - DNA, 1054 bp, Homo sapiens
ttttttctttttgtaagtagtgtattttaaatagctttcaagatacacatattttttcctttaaaaaagtctgttggagcagttttgttcttgaattttgctggtcatcctcatggtcccgagcccccctactccgggtcgtggaggcggccgagggggaggctgggggcccacgtggcccgtcctggcggcacctgcagcactgggggagccgctgaaccccgtgcttcagcgctgggggagccgctgggccccgtcttccgccacaaaccatgcatggccgccacgtgagctcaaacgtccgtttatttcaaagcagtaataatttaaaattataaaaatctttccaccgctgaacgtttagagggtgaggtcctcgtgccgaattcggcacgaggctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaa

SEQ ID NO: 294651 - DNA, 2598 bp, Homo sapiens
cacgcgtccgcggacgcgtgggcctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294652 - DNA, 2576 bp, Homo sapiens
  misc_feature (32)..(32): n is a, c, g, or t
aagaaggcagtctggaaggagacacatgagtnaataattaagttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294653 - DNA, 2560 bp, Homo sapiens
tactaaattcgcggccgcgtcgacttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294654 - DNA, 2800 bp, Homo sapiens
  misc_feature (5)..(5): n is a, c, g, or t
  misc_feature (9)..(28): n is a, c, g, or t
  misc_feature (30)..(31): n is a, c, g, or t
  misc_feature (34)..(36): n is a, c, g, or t
  misc_feature (38)..(38): n is a, c, g, or t
  misc_feature (54)..(54): n is a, c, g, or t
  misc_feature (58)..(58): n is a, c, g, or t
  misc_feature (66)..(66): n is a, c, g, or t
  misc_feature (70)..(70): n is a, c, g, or t
  misc_feature (73)..(75): n is a, c, g, or t
  misc_feature (85)..(86): n is a, c, g, or t
  misc_feature (88)..(89): n is a, c, g, or t
  misc_feature (93)..(99): n is a, c, g, or t
  misc_feature (106)..(107): n is a, c, g, or t
  misc_feature (116)..(116): n is a, c, g, or t
  misc_feature (119)..(119): n is a, c, g, or t
  misc_feature (121)..(124): n is a, c, g, or t
  misc_feature (126)..(126): n is a, c, g, or t
  misc_feature (128)..(129): n is a, c, g, or t
  misc_feature (131)..(133): n is a, c, g, or t
  misc_feature (137)..(137): n is a, c, g, or t
  misc_feature (140)..(140): n is a, c, g, or t
  misc_feature (144)..(145): n is a, c, g, or t
  misc_feature (159)..(159): n is a, c, g, or t
  misc_feature (164)..(164): n is a, c, g, or t
  misc_feature (167)..(169): n is a, c, g, or t
  misc_feature (171)..(172): n is a, c, g, or t
  misc_feature (181)..(185): n is a, c, g, or t
  misc_feature (193)..(195): n is a, c, g, or t
  misc_feature (198)..(198): n is a, c, g, or t
  misc_feature (200)..(200): n is a, c, g, or t
  misc_feature (208)..(208): n is a, c, g, or t
  misc_feature (214)..(215): n is a, c, g, or t
  misc_feature (229)..(231): n is a, c, g, or t
  misc_feature (233)..(234): n is a, c, g, or t
  misc_feature (261)..(261): n is a, c, g, or t
  misc_feature (294)..(294): n is a, c, g, or t
  misc_feature (297)..(297): n is a, c, g, or t
ataanaaannnnnnnnnnnnnnnnnnnnannccnnnanccccatttattatacnccanaaaacaantttnacnnnaaatcactcnntnncccnnnnnnnacccccnntattctcanccncnnnnananncnnnaaanccncaanncaatatattttttnatttnttnnntnnaatttaatnnnnnacattcannnatntnaataatantctatnncccccccccccccnnntnncggcccccaggtaatgggggggggcgnggggggggtgggggaggcattacgccctgtggnggnttgtcttaggcatattgggagagggggggaattgagttgcggggggattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294655 - DNA, 2438 bp, Homo sapiens
tcagctcggatgcgacgcttggctcaggtacgtggtttacatacgtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaattcttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctga

SEQ ID NO: 294656 - DNA, 436 bp, Homo sapiens
accttggctgatcgcgcctgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagcaagtgcattttctatagtctaaactagtataagaggctaatattgtgcagcatctctgcttctgagcagcagctcagcatcagca

SEQ ID NO: 294657 - DNA, 5248 bp, Homo sapiens
  misc_feature (1990)..(1990): n is a, c, g, or t
cacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtaatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagcnggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattagga

SEQ ID NO: 294658 - DNA, 1277 bp, Homo sapiens
tagggaatgcgaccaggccgtcgcggacgcgtgggctccggtcactggaactctgcggggtgttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttc

SEQ ID NO: 294659 - DNA, 1398 bp, Homo sapiens
ggccaagggattgctgcagccctcatccaccttccaagcactggaaacaaacattggagaccaaggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttc

SEQ ID NO: 294660 - DNA, 1216 bp, Homo sapiens
ggcgtgcagccacatggagttctacaaccagtacggcgagcagggcatgtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttc

SEQ ID NO: 294661 - DNA, 1425 bp, Homo sapiens
tttcaccaaagtttccccaaaggtttgccgaaaaatggggcccaaaaccctttcggggaaaacaaaacactttcggagaaatccccgttatgaaaatatcccccgcgatttctataggtttctctattaaagacacgcctcccattcgtctgccgtaaaattggggccctcacggggtttttccacaaagagtggcaaacaacttttggcgccggagggacctcctccccgagggttttggtcccatctccgcgagagggtttccctaaaaagggcgctcgggaaaaagggtaacggggcccctataacacctcggaattcagggggccccctatgaagcgggcccgttccgcaaccgccatgaaaaccaaatttgctgttaaccaccctggaggggaatccacccaatgggagaggcccgttgttcgaagccctcaataccccattggggcgctctgggtttgcgaccaaatcccgaaacccaagcccctttcccaaccccgatacctgaaccaatggaattcaatcccctcgctaggatccgacctgcacatggccggcaattgcatgcgtcaacgcaatacgatggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttc

SEQ ID NO: 294662 - DNA, 181 bp, Homo sapiens
tgggagaggcacacttctaactgctgatgccaccctcaaagggtctccagaagcttccactgactgctgttggctgcaccaggcagtgagtatcagtacatttaatcatcacaaaaaccgggcaggcagatgttggcggattgtctgtgggctgctgaagagctggtagagctcagcgcgt

SEQ ID NO: 294663 - DNA, 1202 bp, Homo sapiens
cttggacacacagcctcttcccaccacagaattgcatatgttacagctgagttggttagggatcttcacagctcatggaattagcagcaatagccaataatagtctcccatcatacagaaccctgtcatccatgggagcttaccacgtggatgcagaagcttttgtgaggggcagcccggaccatcttttggacttaatataccgatatgaagattcagatgcatctactcctcggttgggtggaagagtgatccaggttggtatgcctatagattctgataaagtcttgtgctacttaggaatctgaagagcaaacacttaggccggtgctcatcacatatccttgacctgcagagtcctgaagcttcagcctactaggcagctcagcctagaagctggtcccgcggggctttcagaaatggcaggaagtagacttgcccattcctgacaagcaagattccatagtccttcaggctccatcttaattgatcccagatcttctgcccccaatgtattgtgcatctaatcaaaagcttctttctagctggctccttgggtttcagctacatttcttagatgatcccgaaggtctagataacaagggggcgtagctgaatggaggttaacatttcctgctggactgtaaacttaagggcccaggtcttgtgtgtgtgtgtgtgtgtgtgtgtgtctgttttaacctaatgatttgtatatagtgagtactcagtaagtacttgtcaaatgaaagaacagggattgccagaccttcaaggcaatgggaaaggagcaaatctgcaaaggtaggatctctttggaaggcaggtattggccaccaagtcaaactccttgagtcttatattctgattgggatgatctcacatggatgttcatctcttatatgtgaatactcatttgtgaaaaatagtaagagccagctaggatatttggattcagtcaggcaccatcagaatagtgcagtgaaaggccaaactggccacaagacagaggaatgttttcagttttctggttttcctctggtccatgataaagctcggagtaactcttctatcaagatggggctataccttctcatgacagaggctggcaattgagctacccagcagaacgtgtgctctcaaaagggaagtcaagggaactgggttcctcttctccctctacttctgagccaatgcttcat

SEQ ID NO: 294664 - DNA, 468 bp, Homo sapiens
cgtcacctccagcaccttaatctgttcttcagcagccgcccgcacctcctgtactggggataggatcccggtgagcgtatccactaacgcttcctttaatccttgtgccactggacccggcagcccggaggccgcaccagctgccgccgccgccgccatcttttctcccctcagcccgccagccccgcggccgggacccgccaccgaatgacggcccccgcgcgcggccaatccgcgaagccgcgcctgcgcaccagaggcgggcgggagcgggcggagggcggggaatgaatctaagcctccagagacagcgcctcctgctgcctgaacgagaactgcacctttctctgcaaggatctctggatttgtgtgaaaactgagccccagacaggttaaggggctttcctaaagttgcacagtaagttagcaatctcatttggaataaagttcatgatatatgactttata

SEQ ID NO: 294665 - DNA, 739 bp, Homo sapiens
cgtcacctccagcaccttaatctgttcttcagcagccgcccgcacctcctgtactggggataggatcccggtgagcgtatccactaacgcttcctttaatccttgtgccactggacccggcagcccggaggccgcaccagctgccgccgccgccgccatcttttctcccctcagcccgccagccccgcggccgggacccgccaccgaatgacggcccccgcgcgcggccaatccgcgaagccgcgcctgcgcaccagaggcgggcgggagcgggcggagggcggggaatgaatctaagcctccagagacagcgcctcctgctgcctgaacgagaactgcacctttctctgcaaggatctctggatttgtgtgaaaactgagccccagacaggttaaggggctttcctaaagttgcacaaaccctgtcatccatgggagcttaccacgtggatgcagaagcttttgtgaggggcagcccggaccatcttttggacttaatataccgatatgaagattcagatgcatctactcctcggttgggtggaagagtgatccaggttggcagccgtcttgttgatgtcccctatgtcatccagagggcaggagcgggcagctctctaccttggcaactggttcctctctctccagcttcatcttttccattgttttttgtttgtttgcttgtttttgtttttcatttttaccttttacagattgatttaaacattttttaaaccac

SEQ ID NO: 294666 - DNA, 607 bp, Homo sapiens
cgtcacctccagcaccttaatctgttcttcagcagccgcccgcacctcctgtactggggataggatcccggtgagcgtatccactaacgcttcctttaatccttgtgccactggacccggcagcccggaggccgcaccagctgccgccgccgccgccatcttttctcccctcagcccgccagccccgcggccgggacccgccaccgaatgacggcccccgcgcgcggccaatccgcgaagccgcgcctgcgcaccagaggcgggcgggagcgggcggagggcggggaatgaatctaagcctccagagacagcgcctcctgctgcctgaacgagaactgcacctttctctgcaaggatctctggatttgtgtgaaaactgagccccagacaggttaaggggctttcctaaagttgcacaaatggcttctactcaccagaggatctgagtccagagaacttggggtgctgtctttgactgtcctatcctcgggaggcgcagtggctcatgcctgtaatcccagcatttagggaggccaagacaggaagatcacttgaggtcagaagttcaagaccagcctggccaacgtggtgaaaccctgtttctact

SEQ ID NO: 294667 - DNA, 1356 bp, Homo sapiens
tgattaagagactgagtcagttcccacttgtgaatagacagcatgaaggctttaaacctctctgaacctgatcagcattggcaatgatcttctgcagatccaacaacagcacagaagaatgtatcatcaggaacacatttggatattgacacaacttcatctgcagttggcttgtcatcctgagctccgttcccaggcagcgtagatattgcacaggattttgctgaccagggagttgggttataagtggtaactccaacctcttaatactaacgacattgacagtaccatataatccatctattacaccacacaggaaaatcaagcccagtggtacaggacagaagaactggctccagccaggatcaagcattgctttggcattgttccccaatacctgggcctttcttctccaattgttggggtaactggagtgaggagcctgaggggacccaaaggtgttctcctggtaggattccctctcatggtcttctgcatttgtagacattttgattggttccatttctaagggccaattatctgtgctttaacctgaaataaggaacctgccttctgatcttcaaggatatgtacatggacacacatctttcagattcaactcttgagatttttggttttaaacaaacaattgtgttcatcacaaatgaagattccctcaagcagcagccgcctggaatcaactgctgagtccaaatcttgtagcccttaaaaatatttagtatttttactaagtaataagtatttagggtgttatgaaaaatgcaatttgaaaaagtacattggtttttaagaacaagaggaactatttagaaattatacaatatattaacaaaagtaaatatttaatatatctcaaacacaaaaatgcaaaaactggttaccaagcatcaagaaaaacttaaaacttgtaaaatacaaaggttaaatgtattttatcttcattctattattagcagataaccttaataaaaatgagctgttatttacagcaaaatatcatgtaattttagatttatcactttttatttctatggaaaagcaacaccagcatgtattgttgctgaaggtgaagcaactttttgattctgttctgttccactctgtgttctaagatgtgtgtcagataccggccacacaccctacatgtgctcggggcacagcctggccccacacagcactctagtctgcaggtgggcatctaaggccctgccattcccacttcttattgtcatatttacttagttctcagcacctctgcccatctttaaatgacttaagtgagagtatgttaaagtagcttacatgttcctaagcttcctcacagcacatcccatc

SEQ ID NO: 294668 - DNA, 955 bp, Homo sapiens
tgattaagagactgagtcagttcccacttgtgaatagacagcatgaaggctttaaacctctctgaacctgatcagcattggcaatgatcttctgcagatccaacaacagcacagaagaatgtatcatcaggaacacatttggatattgacacaacttcatctgcagttggcttgtcatcctgagctccgttcccaggcagcgtagatattgcacaggattttgctgaccagggagttgggttataagtggtaactccaacctcttaatactaacgacattgacagtaccatataatccatctattacaccacacaggaaaatcaagcccagtggtacaggacagaagaactggctccagccaggatcaagcattgctttggcattgttccccaatacctgggcctttcttctccaattgttggggtaactggagtgaggagcctgaggggacccaaaggtgttctcctgagcctaaggaggacccaatggcaggcatcagcacagctgaacaccacctggaccccactgcagccctgcccacgcagctctcacggagcagacacagtcctcaagtaataagcacagatggaggagaaacgagaggctgtggaaggcaggagagaaaggccgagagacgagtttgtaagaatgccaaagtcaccttccccattgtgggaggaaaatgccaaaggcactggttctgctgccacaggcagtctgagcacctggagttgtgacgtccttccaggagaggtgccaccaaggagcaggaggtttgtcaaagctctggtcccaccaacaagaacctcccaaagcaaagcagcccccattgaggttccaaggtcgttttgctgaagacgggaacgaaaccaacaccaaagcgacagggggttgacagaggggacaggggctgggcaccggcaacatggagccgttcaagtaaacataaaccac

SEQ ID NO: 294669 - DNA, 809 bp, Homo sapiens
  misc_feature (808)..(809): n is a, c, g, or t
aatcgagatctcctgcgcgaaggccagcgagatgagcagcaggggcagccccaccgcaatgcacgtgaccatcttgtccacagccagctccagtcgcagccccttgaacttgggctccgtgggctccttcagcaagaaatccgagaacacgtactccgtggccaggtggtcgctgacctggcaggttatcatccacttcccaggattctcggctatcatttctgttgtaaggaaggtggctgggaacaggttgacgacatcagtccgatgccctctgctgatgaaggtgttaccatagaaatagatagaatggatgtctatttcattccccattccaaataggtgccaggacacagattctccaacacacatatcaggctccgggaagtttccgaagaggtatccattgagggctggaaacagaaacacgctagtggaagagactcccctgcagaggcgactgggaccagaaatgttgagaaaacactcaataaaagtgaagatcagcatacactgagaacagcctcggagctgctgtgggaacgcaatatgaggtcaggagaaaacagagtgctgctcatatttacaggaggctcagtcaccttctgtcataatccttcactggcatatctgctgtctccaccagattctgtgctccttggaactagaaaccctgtcttgttcatcttaacagttatcaggacctagcagaaaaactggcacatagtatctacttaatgaagtgacaaaagcatgtagtaagatggaaagaaaaggaattgattaaaaggaatttatgagaaaaaann

SEQ ID NO: 294670 - DNA, 523 bp, Homo sapiens
aatcgagatctcctgcgcgaaggccagcgagatgagcagcaggggcagccccaccgcaatgcacgtgaccatcttgtccacagccagctccagtcgcagccccttgaacttgggctccgtgggctccttcagcaagaaatccgagaacacgtactccgtggccagttgagcgatggccatggctgcggcgcgccaggctcgaccaggaggtccgggtacagccggcgtcgggaaagctgcgcggcgccttcacccagtcaccggccgggcgcgcggctttcgctttccctttgcctgctcccgcatcccgcctgcctttgtgtctcggtgcctcaggctcccagcgactccgctgggctctcgcgctcgctgcctccgccgccggcggggcggggcggggcgggaacccgagagctccgcttcctgcggttccaccccgcacgcccgtgcaagtccccgggccgcgcgcggcactcggattcgcgcctctcccgcgcacccccaggcgcgggaaccacgcgcg

SEQ ID NO: 294671 - DNA, 944 bp, Homo sapiens
  misc_feature (943)..(944): n is a, c, g, or t
aatcgagatctcctgcgcgaaggccagcgagatgagcagcaggggcagccccaccgcaatgcacgtgaccatcttgtccacagccagctccagtcgcagccccttgaacttgggctccgtgggctccttcagcaagaaatccgagaacacgtactccgtggccaggtggtcgctgacctggcaggttatcatccacttcccaggattctcggctatcatttctgttgtaaggaaggtggctgggaacaggttgacgacatcagtccgatgccctctgctgatgaaggtgttaccatagaaatagatagaatggatgtctatttcattccccattccaaataggtgccaggacacagattctccaacacacatatcaggctccgggaagtttccgaagaggtatccattgagggctggaaacagaaacacgctagtggaagagactcccctgcagaggcgactgggaccagaaatgttggtaatacgggcttaagcatggctggaaaaccagtgcagaccattggttgtaaggttttggtgcagaaaaacctggctcttagaaatatatattgtccaaaagagaaatgaaatgtttttattggcctttttccagagaaaacactcaataaaagtgaagatcagcatacactgagaacagcctcggagctgctgtgggaacgcaatatgaggtcaggagaaaacagagtgctgctcatatttacaggaggctcagtcaccttctgtcataatccttcactggcatatctgctgtctccaccagattctgtgctccttggaactagaaaccctgtcttgttcatcttaacagttatcaggacctagcagaaaaactggcacatagtatctacttaatgaagtgacaaaagcatgtagtaagatggaaagaaaaggaattgattaaaaggaatttatgagaaaaaann

SEQ ID NO: 294672 - DNA, 356 bp, Homo sapiens
actaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagct

SEQ ID NO: 294673 - DNA, 285 bp, Homo sapiens
tcactagggtcccagtcaggggcatctggtgaccttaggcctggttagtagcggcctgatcagtggcaacctgttccctggaggcctggtcagtggggcctcatctttggggccagggaatgaggtcatgatcagtggaacctgatcagtgaggccttgtcaataatgacctagtcagtgaggacttgtcagtaaggacttggtccttgaggccttgtcagtgaggccttgtcagtaaggtcctggtcagtggagtccttgtcattgtgtgcctggcagtggggg

SEQ ID NO: 294674 - DNA, 579 bp, Homo sapiens
  misc_feature (477)..(477): n is a, c, g, or t
atgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagcnctcacccagagaggcctgaaaaccgtgttcgacgaggccatccgggccgtgctgtgccctcagcccacgcggcagcagaagcgcgcctgcagcctcctctag

SEQ ID NO: 294675 - DNA, 1665 bp, Homo sapiens
ggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccagaccctcagcccatggagtcctgtgtgatgttgtgagcgtgggaggacagactgaactgctcggcccgtggagtcctgtgtgatgttctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaacattatatttttattatttatttatttatatttaattcttttttagagacagggtcttcttaggttgcccaggctggtcttgaactcctggcctcaacgatcttcccacttcagcctcctgcattgctgggattataggtgtgagccaccatgcctggcttacacagtataaagggaatgcattggcccacacagtggaaaaaaatatctagtaggaataggaaggacttcaggtgaggtttgatccagcagctcaaatgttgtcaccacaggcctggattcctctggcctttctcaaggtctctttcattttcatgctccacaagatggcttctgccaggctgacctccctcccctgaccccagcagctctggacacccctctcagtgccatttatattgttgcatcaataggctcatttctatatactgcaaggttcagagaagacagagtatctctctcaagagttctaacataagtctgggggtcctggctctcataggcttgaacagggccacatgtccattcctgagccaatatttgtgaccaaggggatgtggtcaatctcatccaaacctcacttgaagtgagggtgggaggaggagtgctctgcaaggagactgtaggtctggaccaccaaaaaggtagatgggttggtgggaaaagccagatgcctactatggtagtgggcggggggagggcacactggcaaggtacagcaagaggcaggggcagtgctggacaggcaggggctcctccctagcacgactggagaaaggactcctgtgaagcggtcacctccatgagtccctcctgtcctggcttccaaccactctgaagtggggcttttgtccacagacctggcctctgctgcctaccctcttctgtccccacctgatggggccgctttccttctgaagcggctgcattttgggtttctctccacaggaagagttggggctcacaggcacaccctctccctaactcttctcccccggttcaacctggatccagggatccacactctgctccgagaggccagcacgcagccactggaaaatgagcc

SEQ ID NO: 294676 - DNA, 2024 bp, Homo sapiens
ggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccaggctagtctgcccccctcactctgggtgctctccatgggccactcaccatttcctgagcaggaccagagctctcctgccccaaggctgggcttcagctgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaacattatatttttattatttatttatttatatttaattcttttttagagacagggtcttcttaggttgcccaggctggtcttgaactcctggcctcaacgatcttcccacttcagcctcctgcattgctgggattataggtgtgagccaccatgcctggcttacacagtataaagggaatgcattggcccacacagtggaaaaaaatatctagtaggaataggaaggacttcaggtgaggtttgatccagcagctcaaatgttgtcaccacaggcctggattcctctggcctttctcaaggtctctttcattttcatgctccacaagatggcttctgccaggctgacctccctcccctgaccccagcagctctggacacccctctcagtgccatttatattgttgcatcaataggctcatttctatatactgcaaggttcagagaagacagagtatctctctcaagagttctaacataagtctgggggtcctggctctcataggcttgaacagggccacatgtccattcctgagccaatatttgtgaccaaggggatgtggtcaatctcatccaaacctcacttgaagtgagggtgggaggaggagtgctctgcaaggagactgtaggtctggaccaccaaaaaggtagatgggttggtgggaaaagccagatgcctactatggtagtgggcggggggagggcacactggcaaggtacagcaagaggcaggggcagtgctggacaggcaggggctcctccctagcacgactggagaaaggactcctgtgaagcggtcacctccatgagtccctcctgtcctggcttccaaccactctgaagtggggcttttgtccacagacctggcctctgctgcctaccctcttctgtccccacctgatggggccgctttccttctgaagcggctgcattttgggtttctctccacaggaagagttggggctcacaggcacaccctctccctaactcttctcccccggttcaacctggatccagggatccacactctgctccgagaggccagcacgcagccactggaaaatgagcc

SEQ ID NO: 294677 - DNA, 371 bp, Homo sapiens
agtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaacattata

SEQ ID NO: 294678 - DNA, 4462 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294679 - DNA, 2616 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgaaaaaaaaaaaaaaaaaaaaacgtttgcggggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgag

SEQ ID NO: 294680 - DNA, 4771 bp, Homo sapiens
tcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294681 - DNA, 4770 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294682 - DNA, 4764 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgagatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294683 - DNA, 4741 bp, Homo sapiens
cgccgcccctgttgaccgtccatgaccccagcgagccagttttcgtgacttagtggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294684 - DNA, 4441 bp, Homo sapiens
tcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294685 - DNA, 4776 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctgggtgagggctccccctggttggcacagggcctggcattgcctgagtctaacgggactcttctaacccaccccgtctgcagcaagtactgacctagggagctgcagggtgtcagcctgggctccccacagtcccatctttgttcatctttcctgtgggggggtttctgagggatgtcccccaacatgttctcatcccacaccccttccccagatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294686 - DNA, 4363 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctcgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294687 - DNA, 4411 bp, Homo sapiens
cgccgcccctgttgaccgtccatgaccccagcgagccagttttcgtgacttagtggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294688 - DNA, 4012 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294689 - DNA, 4186 bp, Homo sapiens
tggccatctgctgggaaccattgccttagtcgggaaagtaaagccagtctgaaaatgctcacttgtgggggcaaatacatatttcttgcattttggcttattttgaaagggctgctattcagttctcaaaaaagtgtttgagaactgtttcctctgttctttcactgaccattataagtgcttccatccattttggggtagctgtagcaggtagcagcatggctgatgagactgagaatccactgagaactgtctactgaatcactgatccccctcgcaaagtggaactgtacagaaagatgacacctgcagttacgtttatgtgtgaccagtctaaactaagtttactggttggagaatatttctaaatcccttatcagaaagaagcagcttctaggtgtccccagcctctgtgggtagttgctgccaggcgaaggagtgtctgggcctgtgtaagtccttctctgttcccgacacagctcatgggccctggatggagggtcctgccattgcccctggccatgcaggctctcctcagactcagagccaggcaggaggacagcgtgctgggcagagagcttattctgtccctctgctatttctgacccacccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294690 - DNA, 3501 bp, Homo sapiens
ggacgcgtgggtccggacgcgtgggcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294691 - DNA, 3622 bp, Homo sapiens
tcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294692 - DNA, 2895 bp, Homo sapiens
  misc_feature (66)..(66): n is a, c, g, or t
  misc_feature (73)..(73): n is a, c, g, or t
atgttgggtggcgcatgtacccatttcccggcgcgaggagaaaagttctgtggcaactctatgagnggtttgnaggtgaatacctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294693 - DNA, 479 bp, Homo sapiens
gtggccacgcagtatggctgggtgctgggtgagggctccccctggttggcacagggcctggcattgcctgagtctaacgggactcttctaacccaccccgtctgcagcaagtactgacctagggagctgcagggtgtcagcctgggctccccacagtcccatctttgttcatctttcctgtgggggggtttctgagggatgtcccccaacatgttctcatcccacaccccttccccagatgctgaggtgctgctggacagtgacggcgagtttctgcccgtaagggactttgtggcacctcaccttgcccagccaactgggagccagtcaccacctccagggtctaagaggtaggtggccagggacctgttggccatgggggcaccatggctgttggactgcatattctttgctttccatctttcccctccgaggggctgggagagtggaagcatgtcagccacctcttcttccttcca

SEQ ID NO: 294694 - DNA, 4792 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294695 - DNA, 4858 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctaggtgagccccctgcccctagtactactggaactgggaaactgcctggtcttgtctgcctagtgccagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294696 - DNA, 5002 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctgggtgagggctccccctggttggcacagggcctggcattgcctgagtctaacgggactcttctaacccaccccgtctgcagcaagtactgacctagggagctgcagggtgtcagcctgggctccccacagtcccatctttgttcatctttcctgtgggggggtttctgagggatgtcccccaacatgttctcatcccacaccccttccccagatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294697 - DNA, 4748 bp, Homo sapiens
tcgtttccgccggcgctccgagtgacgtagggaagcgcgccgcgcacctcatggttccggggacagttagggcggcggatggaggtcagcggtggtgctcgctgcgacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294698 - DNA, 4724 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagttgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294699 - DNA, 2362 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgagatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacccactctgagggacagaacgtcctcttgtgtataataaacctttaattttggtgttggacccctggggccttcccaggcttggtcaccctctgcactgaaaaaaaaaaaaaaaaaaaaacgtttgcggggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgag

SEQ ID NO: 294700 - DNA, 4666 bp, Homo sapiens
tcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatgattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294701 - DNA, 4223 bp, Homo sapiens
tagtaggtagggacactggtaatctcgttcatccattattgcgcgtcactaagtagatgtagaggcatttggctaccgtaagagagtcatagttactccccccgtttacccgcgcgtcattgaatttcttcactttgacattcagagcactgggcagaaatcacatcgcgtcaacacccgccgccgggcctttcgcgatgctttgttttaattctgtaagcggatcagcgctgatcgctaagggggagcgctggccctgcagatgcctgcagccgtgtcaaattcagtacctgtcctatgcatggtaggcactggcccagaaggctgccacagaaacactgtgactcatgggccctgttcctgtgtcccaggctcagggataaatttggttacagacatcaaatatctagacctcgaggctgaggtggggtggagctgctgggtgattgctgactctctccagctaaaccctgtgatctgctctgtcctgaaggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgccactgcactccagcctgggtaacagagcaagactctgtctcaaaaaatatatatgtgtgtgtgtgtgtgtgtatatatatgtacatgtgtatataagtatatatgtgtgtatatatgtatatatacacgtatatacacacacacccctaagtcatgattttggagcaattgtaagtggtgtagtgcttaattttggcattcacacattgattgttagcatatagaaatgggattgatttttatgtgatcttgctaaactttatgcatttttaaaattcctttggatttcctatgtagatatttatgtcctgaaaacaggaatgtatttatcctttcaaatcaatatgctttttattttgttatttatgaccacttcattaaaatataattcacatgccatacacttcacccatttaaaatgtataattaggccaggtgtggtggctcacgtctgtaatcccagcagtttgggaggccaaggccctcagatcttgagcccaggagttcaagaccaccctgggcaacaggcaaaaccctgtctctattttttaaaatacaagaattagccgcagtggcacgcacctgtcgtcccagcaacccaggaggctgaggtaggaggatcacttaagcctgggaagtcaagcctgcagtgaaccatgatagcaccactgcagtccagcctgggcgacagagtgagaccccatctcgaaaacaaaaatgtataattcagtggtttttagtctctttgcagatacatgcaaccatcaccacaatttgcacattttctaagcctcatatactgatgtgatattttggtgttttgtgactggcttcatttacttagcatattgttttcatgtttcattcatgtcgcatgtatgagtattcattcctttatttggctgaataatattccattatagtttgtgccacattttgtttatccattcatccattgatggacatgtggattgtttccaccttctggataatatgaactgatacagtttggatattttgtcccctccaaatctcatgaaataggatcaccagtgttggagaatggggcctgttaggaagtgtttggatcataggaacatctgtcataaatggcttggtgccatccttgtaatgagtgagttcttgctctatattagttcacttgaaagctggttgttgggaactcctgccctatctgttctgccctctctcgtcatgtgacatgcctgctccttgttcaccttctgtcatgagtaaaagcttcctaaggccttcccaggagccaagcagatgtcagtaccatgcttgtacagcctgcagaactgtgagccaaataaacttctttataaatta

SEQ ID NO: 294702 - DNA, 920 bp, Homo sapiens
tcgtttccgccggcgctccgagtgacgtagggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaaggccattgagctgacctctgcgcggctgtgg

SEQ ID NO: 294703 - DNA, 789 bp, Homo sapiens
cagttctcaaaaaagtgtttgagaactgtttcctctgttctttcactgaccattataagtgcttccatccattttggggtagctgtagcaggtagcagcatggctgatgagactgagaatccactgagaactgtctactgaatcactgatccccctcgcaaagtggaactgtacagaaagatgacacctgcagttacgtttatgtgtgaccagtctaaactaagtttactggttggagaatatttctaaatcccttatcagaaagaagcagcttctaggtgtccccagcctctgtgggtagttgctgccaggcgaaggagtgtctgggcctgtgtaagtccttctctgttcccgacacagctcatgggccctggatggagggtcctgccattgcccctggccatgcaggctctcctcagactcagagccaggcaggaggacagcgtgctgggcagagagcttattctgtccctctgctatttctgacccacccagcacgtcctgaacagagcgcaggacatcaccctgccccacctgtgcagcgtacttctggcttttgcgcgtctgaacttccatccagaccaagaggatcagttcttcagcctggtagggcctctgggctcccactgctcgacctttatcctccccttcagctaatggctcatgaaccgtcctcccaagatcagctcgggctaggtggaggcgggaggggccactatgtgtggcatgggagggcagggggaactgattggagccaggcatcctagggattactgagaacacatgaaa

SEQ ID NO: 294704 - DNA, 243 bp, Homo sapiens
cgatggctccgctcagaatcccgataggaaggcgtcggggagggcgattcccactgtgagcgccttgaggagccatagccactgtcctcttcctcccaggaaccatatccaccccaagtgcagagctgtgcccacctgactcagaaccaactatcccaagatgttcatggtagaatcgggaattctgactcaatgcctcagcaatctcactgaagacgagagtcactcactctgccttttata

SEQ ID NO: 294705 - DNA, 469 bp, Homo sapiens
aaataaaaacaaattcatagcagagctggaaattgaggttaaaaagagaatttaaaaaataaatgcgttttcctagaacagtataaattttcagttataaagggattttgataacttgagtaattcattttccctgccccagattttcttaatgatccagaccacctgactttagattaaattaagcttgctgagatccttttgtggatcataagcctgatgattgggttttcacactgtgtgagacaggcctctctcaaaccttgttgcattgtgcacacattacctgtctgacatgggggaagaaattcagcttgatgagataccaaaatgtgaggtgtattctcttgacagagagaaacttatgctaaaaacatttctgcatttttgggtgacttacttaaatatgggactgttatccacccttttacagctggctttagagtagaaggtctcaagtagcatgcgt

SEQ ID NO: 294706 - DNA, 784 bp, Homo sapiens
cctctccattacactggctatgggcctcagtttccccatatgttttttagaggttgtggtgtgacctcttaagatctttgcagtaaaatcagctcagattcaaatccctgctcccctgtctactagccatgtgactttgagcaagactttgagcaagcctcagtttccccatctgttaaaagggaatcataatactcttcatggtggtgagaattccatacagtaacgagtgtgctgggcacactggtaggtgctcagtagcttcactctgcctggcctcccttttggaccaccagggctgctcacagcttggcaacaacattccttcctcccagcttttgcacaagctgttccctctgcctggaatgacggaaccgtggcacaggctccactggtgttttaagagggttaagcctcttcttcaaatggtgccattttctctccagagtgacccccagcctcgagtgttttagttgttagaagggagtgaggtggacacatgggcctggcatagagccagcagccccatcctcttcttcccggcctcttttgcatccacttggcttccctgccccccatgcgtggattgccagctggcaatccacggatggagtgcagtggcacaatctcggctcactgcaatctctgcctcccaggttcaagtgattctcctgtcccagcctcctgagtagctgggactacaggtgcgctccaccatacctggctaatttttgtatttttagtagagaagggttttgccatgttggccatgcgtggatttaat

SEQ ID NO: 294707 - DNA, 595 bp, Homo sapiens
  misc_feature (75)..(75): n is a, c, g, or t
ccacagtggagtggaggaatctccaaggcaggggtccatgccatgcgtggattgccagctggcaatccacgcatngactctgcctggcctcccttttggaccaccagggctgctcacagcttggcaacaacattccttcctcccagcttttgcacaagctgttccctctgcctggaatgacggaaccgtggcacaggctccactggtgttttaagagggttaagcctcttcttcaaatggtgccattttctctccagagtgacccccagcctcgagtgttttagttgttagaagggagtgaggtggacacatgggcctggcatagagccagcagccccatcctcttcttcccggcctcttttgcatccacttggcttccctgccccccatgcgtggattgccagctggcaatccacggatggagtgcagtggcacaatctcggctcactgcaatctctgcctcccaggttcaagtgattctcctgtcccagcctcctgagtagctgggactacaggtgcgctccaccatacctggctaatttttgtatttttagtagagaagggttttgccatgttggccatgcgtggatttaat

SEQ ID NO: 294708 - DNA, 567 bp, Homo sapiens
atctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaagtgttgaaaagtctcctctagagctttggaaggctgaatgcactaaacatgaagagcttgaaagcgaagttcaggaagagtgacgtaaattaaataaaactcatagagtgcaaagagacttcgacagaaaactagctgttggccagagtgaaagtcctggtcatccgacttccgagaaacctccttcaacctcatcgtctgctggctgtatgttatgcagcctacatatctcccgtggctttcagctaaggagaaaaaggcaattaaatggaaaatgttgcccaattcagcagaaaggggtt

SEQ ID NO: 294709 - DNA, 4902 bp, Homo sapiens
gggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294710 - DNA, 5043 bp, Homo sapiens
ggagttgggaggctcccggcgcggggtcccgggctcgtgtccccgcctttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294711 - DNA, 768 bp, Homo sapiens
gggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactggtttgcagatatgctggttctgggtttttggggtgttctctggaatccttagtatccataggggaatttcacacgtgctccctctccactcccatgttgaaatatgtaagaagatattttaatctagtgcctttctctccaaattccaagtcacatatggagctctaccttgaatgggtatacatgttcccaagtataagcaaaggttttacctcctaagattgcaaccaattgtagatgagacatgaattctctcttcgataagaaatagcataaaagagaaaaaagtattttcctataaccctcaaaccttactgtgtatttatcttaaactacttgtttatttatttgatcttccttaacatagatcattaagtacatgagtagtatgattttgctttatggtttgctgtatgtagtactcttccttgccataattaaagctgtatatttgattaagtatttgtgtgtg

SEQ ID NO: 294712 - DNA, 507 bp, Homo sapiens
atctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtgttgaaaagtctcctctagagctttggaaggctgaatgcactaaacatgaagagcttgaaagcgaagttcaggaagagtgacgtaaattaaataaaactcatagagtgcaaagagacttcgacagaaaactagctgttggccagagtgaaagtcctggtcatccgacttccgagaaacctccttcaacctcatcgtctgctggctgtatgttatgcagcctacatatctcccgtggctttcagctaaggagaaaaaggcaattaaatggaaaatgttgcccaattcagcagaaaggggtt

SEQ ID NO: 294713 - DNA, 377 bp, Homo sapiens
tttcttttttagttgagtgatgtctcttccccaagatcaataacttcgactccactatcgggaaaggaatcggtattttttgctgaaccacccttcaaggtatttcctttctgtattcagttttgttactgtattttaagatacatgatagacttgctttaagttatataacactgggaaaaacagaatatacttctgaatcattggttcacaaccttttcaccatgaagtaccccttgattattttttctggcatggaccccataaagcaagaatgtgtacagctagtttgtatccataataatttaaaatttttaaaaaatcattgagtgaataaattaaatttacaaaccaataattgattttcttcatttaaa

SEQ ID NO: 294714 - DNA, 5152 bp, Homo sapiens
atctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294715 - DNA, 4787 bp, Homo sapiens
ggccttcttgggtgtctccatggtgaaggggaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294716 - DNA, 5166 bp, Homo sapiens
taaaatacatgaagagaaaataatgaatttggaaaattctgtcattctgttttctcagcaggacacaagcattctgcagcataatagttggaaagtccccagaatagagaaaaaaagtcacttattgatctaaactctcaatgggagagggaggacaaaataaaatctctcgctatcacacgatttattaaagcgtatgcaatgaagctttaactaactggatccctgaaaatgtatttcagccatcaaatatataaatttaggttgatatcagggattttcttttacaaagctatgtctaagaaaattcttttgtgggactggaaattgagcgcagcttcctaacacctcacttctgccttgtattgatcgtgggccttccaagtgatgatcctgaaactctgcatttcccaaatcatttgtagaatatcataacacgttcatcagactgcatttaccaatgtacaggagtggcctacaataatgcttcactgtcagatggtctgcagttccagccacccataaaagactatgtaatccagagtttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294717 - DNA, 5004 bp, Homo sapiens
atctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294718 - DNA, 4874 bp, Homo sapiens
cgtcgacagttccagccacccataaaagactatgtaatccagagtttccatcttgctgctgcaaaaggacacgtggaatgcctcagggtcatgattacacatggtgtggatgtgacagcccaagatactaccgaatatcataacacgttcatcagactgcatttaccaatgtacaggagtggcctacaataatgcttcactgtcagatggtctgcagttccagccacccataaaagactatgtaatccagagtttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 294719 - DNA, 5184 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294720 - DNA, 6121 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294721 - DNA, 6431 bp, Homo sapiens
ttcttaaaatgctgtagcaatatgtcagcctgtttctttcagaagccttttgttaaaggttgaagacgattaaaaagaacagaacaaaatcagattatgtattttgatagatgtgaacatataaaaattttctgagcttttttccaaaaatttttgatggctgatgttcatttccctattatatttacaagtagtacatatttcaaaaaggttggatgaaaattaccaatactataaaaagaagagataccccaaaatgctagtgtttgacagtagccagtgggaaaacaaaaaacaaaaaaagccatcttcatgaaggaaagtagaactttacctgttgtcacctcagaattaggcattgcgaaaagtatgattttatgatctcaaagtatgtttactatgcattatttctagataattttcctgtcctgtaagctctgggtcttgacttaatgaaatgttttctgcttagactagctgaagtgaaacctttaaattcttatccactttcccttcctgatttggctgtttatacctgtaagagtatccatttttgctgggtttcatgtttaacattgaagggtttggactttcatgctctgtaaggctgaattaaagccatcctttttggtactgctacattagcattttttctcaaactcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294722 - DNA, 5957 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgattttctctttgtattttaagatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294723 - DNA, 5992 bp, Homo sapiens
cgcctcctcctgtcgggttggcaggactgttttgacaccgattggccgagttttgcggagcgctgggcagtgctgttgggagagtgctctgggaagaataggcagttttcatggtgatactgctttatctaagacacatcaaatcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294724 - DNA, 5334 bp, Homo sapiens
cacatcgagctcggcctctgttatcatttattagtttttgaagacttcttcactattgtacctgtgcaaatacaagccatttgacaggataaaatcttcagaaaactattaacagtggatatcagagtttcccgtatggatgccctataaaaacaaaaaaaggggatccctcaaaatccgaccggcgggcttgcatctttgacctgggccctcgttaacgatgtgcgtgcctggaaaacctctggggagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggaaaaactgaacttttg

SEQ ID NO: 294725 - DNA, 4442 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagggttgggataagtcttgccgagggagacttaatcagttggatcactcccctaaacatttcaaccgtgggccaaagggacttgacgaattcttgcaaggagcttgtattcctggaaatggaatgctctctatttctcattgttgggctttatttgacattgtttcttgttgttgattttcagtttttaagctggaggaattactctgtgttgattattgtagttacttgtagattgtcattggaaaagattttgtagttacaaaaaaattttagtaggaaacatggcaaactagacatctagagtttagaatgctggctcttctgcatggacttagattttcagttctgtgcagattctcagtcagccttcctgatatgagaagtctgggccccctttcagcagtagagacagtgaagtagaatccacctctgagacgtgttttcttttcactcgttttttgcagattttccgatggtagtgaacataccaccttattgacataggtctgttattcttagttattctttggcaggataactaatactaccagtcacattctttcacagttctaagcatataaagaatctggctcctttgagtcatctccaactttgtcaccttaagcattctttttttttcttctccccttttcttttgaaaaatgctagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttgtttgcattgtcgaccttgaactttggacacccttgaattttagaccttaaaacctcctcatgtaa

SEQ ID NO: 294726 - DNA, 1577 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttctccagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaataggagctgttgtaactggggtaccgaactcgag

SEQ ID NO: 294727 - DNA, 938 bp, Homo sapiens
gaaaaagggaggacagggggcgcggaggcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcaggtaggtttctattgcagaaaacaaacatggagtcctgtatttctgcctgacacatggaaagtgctcaataagtgtcacttattattaaaaattattttgtattatcccata

SEQ ID NO: 294728 - DNA, 345 bp, Homo sapiens
gggtttggactttcatgctctgtaaggctgaattaaagccatcctttttggtactgctacattagcattttttctcaaactcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgaggtatgtggtgctatatatttgtgattactagaaagcatgaaatggttagatctgagggtgggtgctgttggatctaatccttggcctcatgtttcattttctaa

SEQ ID NO: 294729 - DNA, 230 bp, Homo sapiens
  misc_feature (20)..(20): n is a, c, g, or t
  misc_feature (24)..(24): n is a, c, g, or t
ggcccccaaaggatcctttncccnaccaaataggggctcccaaatttttgggggaaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatact

SEQ ID NO: 294730 - DNA, 4673 bp, Homo sapiens
tcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctgctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccagtctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgcccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgggtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatact

SEQ ID NO: 294731 - DNA, 2240 bp, Homo sapiens
tcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctgctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaagcttcctcatctgcaaaattctgcgccaaaagatcgctgagaggattttaaaaaagaaaaaaaaaagactagaactcctaccacacagcagggttttgctcaaacaaaaacaaaagcaaaaacgaccctttcttttcatctccccggctaaggcgatttcttcagcatcaacctacagccccctcgtgcacccagctgaaacgccatcaatatcgcccaacagcttccagacctatctgtgaacaaacaagtgaggtctccaagaacgccaaccgtaaccccacgtcagggagccattttccagtcaagaaaatgaaaaggtgtgcaagaaagacctaaggaataaaatacccctcccagcaatcatcgatgccccttcccacgtcgctcgggacccagcacaaa

SEQ ID NO: 294732 - DNA, 1277 bp, Homo sapiens
agtccacgggcttccggccactgtgcaggggcgctttgctctctgctcccagacagaccctgtcttgctcacagcttcctgcaggctcctctgagagtccagcaaagctgggcgagatgtctcccagggaaggggaacactgacagccgtgctgctctctgctccttccactggaagggagaggctgcatggacagggggctccgggtggggcagatggggacactcaggactgcggcctgaccctcagagactgagcccaggacgtggccacctgaccagcacctcccccgtggctgtcccagcctcacggtcacggcccagcagtccgggaaagccacttacacgtagtgcccggatcctgaccccggtgagggacaggcagggtcccctgggattgggggggggggtgtggttcttggcccaagaaagccccagctgaaagcaccagctacgcaacgaaagggtctgaaaccagaaaattctttattgcaaaggtacaaaagcagtcacagcagcaggacgcacggcaataaattaggtggtggccgcagggacggggcagggcggcggcggccagacacgggcccacatgtgatctgttttcaataatttatatcatgataaaaagcagcacaaaaaataaataatgaaatggaactgccaagtagcacagaagccagggtgaggcggtgtggcggcgtggcggcatagggggccggggtccccacgccctggaaacgcaaagacctggatctctttgggaagccggaggcacggagacagaaaacaaacccacgtgacaaagagtccctcgtctttttcttaaataaaaaaatccatatattaaatcatgacaatgaaatttcaacaatctgaaaagaaaagcagaacacaccgtgcttccccggcccagctctgggcggtgacagcggctccgtccaccctggggaccagggagtcccttctccagcaaagcactgcaggccaagggcaggtagaagcccacggcccacaagacgtggacaccaagaaccccaagacgggacagaaccggccacccgctgcggcctgtcctgcggggcccagctgcctggtacagtccgtggggagatgaagggggacggcgggcagcccgggcctccgctttgctcccaactcccacctgtgcccgtgcccccggctctgctctgatagatttacagtatcaaactggaaaagaaagattgttacgaaaaatctgtagataaactgtgaatataattttatatctctata

SEQ ID NO: 294733 - DNA, 881 bp, Homo sapiens
tcggaggacctgtaggggggcctgggctgccagtgctgtagggacccaggctgcccaggcctctggggaagaacagggtccccccacccaccaactcctgccaaaggtggggcctctcctgagagcccacctgtgaggccctcggagcccacttcccatcctccctccagccaggggtcagggcacctgatggccctggcaggcacccaggtgggcccgccaccgcaggagagggcacctgagccaatcggaagagcctggggaccccctgggatcacccagccatcagccccaggagccactgtggggcggagagtgagtgtggctgcggggccttggctgcacggaccccatgggagctgtgagtgggtcagactccctggttcaggagacagacagcggacggatcccaggctgggcagctggagggaggggcgccggggcgctgggcagccgggctctgacacagtcagcagctccgggcgccgcaggccggcggggtccacacaggctggccggggctgggcctccttggagcctgctacggccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttcacacacacaacaaaacccctcgagcgctctattacggcgcgccgagcacaccggtccaacgggccatgccctagcggtctctgcccccttcttgccacgggaaaccgccggcccttagggacgataatcgaaccggactaacca

SEQ ID NO: 294734 - DNA, 1054 bp, Homo sapiens
agtccacgggcttccggccactgtgcaggggcgctttgctctctgctcccagacagaccctgtcttgctcacagcttcctgcaggctcctctgagagtccagcaaagctgggcgagatgtctcccagggaaggggaacactgacagccgtgctgctctctgctccttccactggaagggagaggctgcatggacagggggctccgggtggggcagatggggacactcaggactgcggcctgaccctcagagactgagcccaggacgtggccacctgaccagcacctcccccgtggctgtcccagcctcacggtcacggcccagcagtccgggaaagccacttacacgtagtgcccggatcctgaccccggtgagggacaggcagggtcccctgggattgggggggggggtgtggttcttggcccaagaaagccccagctgaaagcaccagctacgcaacgaaagggtctgaaaccagaaaattctttattgcaaaggtacaaaagcagtcacagcagcaggacgcacggcaataaattaggtggtggccgcagggacggggcagggcggcggcggccagacacgggcccacatgtgatctgttttcaataatttatatcatgataaaaagcagcacaaaaaataaataatgaaatggaactgccaagtagcacagaagccagggtgaggcggtgtggcggcgtggcggcatagggggccggggtccccacgccctggaaacgcaaagacctggatctctttgggaagccggaggcacggagacagaaaacaaacccacgtgacaccaagaaccccaagacgggacagaaccggccacccgctgcggcctgtcctgcggggcccagctgcctggtacagtccgtggggagatgaagggggacggcgggcagcccgggcctccgctttgctcccaactcccacctgtgcccgtgcccccggctctgctctgatagatttacagtatcaaactggaaaagaaagattgttacgaaaaatctgtagataaactgtgaatataattttatatctctata

SEQ ID NO: 294735 - DNA, 1238 bp, Homo sapiens
cttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagctgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagccgtgcccccggctctgctctgatagatttacagtatcaaactggaaaagaaagattgttacgaaaaatctgtagataaactgtgaatataattttatatctctata

SEQ ID NO: 294736 - DNA, 1220 bp, Homo sapiens
cttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagctgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagcccccccggcacccatgcagagcatctccagcggcatcagggagacagtgagcccccaggacatcgtgcaggacgccatccacaacttc

SEQ ID NO: 294737 - DNA, 1024 bp, Homo sapiens
ccagcgactacaacgaggttccatccgctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagccgtgcccccggctctgctctgatagatttacagtatcaaactggaaaagaaagattgttacgaaaaatctgtagataaactgtgaatataattttatatctctata

SEQ ID NO: 294738 - DNA, 1176 bp, Homo sapiens
tcggaggacctgtaggggggcctgggctgccagtgctgtagggacccaggctgcccaggcctctggggaagaacagggtccccccacccaccaactcctgccaaaggtggggcctctcctgagagcccacctgtgaggccctcggagcccacttcccatcctccctccagccaggggtcagggcacctgatggccctggcaggcacccaggtgggcccgccaccgcaggagagggcacctgagccaatcggaagagcctggggaccccctgggatcacccagccatcagccccaggagccactgtggggcggagagtgagtgtggctgcggggccttggctgcacggaccccatgggagctgtgagtgggtcagactccctggttcaggagacagacagcggacggatcccaggctgggcagctggagggaggggcgccggggcgctgggcagccgggctctgacacagtcagcagctccgggcgccgcaggccggcggggtccacacaggctggccggggctgggcctccttggagcctgctacggccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttctaccgggtcttggcttctgttcccgcagggcatgagcctgaggagcaggacgcggtgggggtcacaggaggctgctgctcagagtctgcatgcgggaaaggggtcccacctgtctggggtgggcagcctcgtggtccagggcagtgcagggcagagcctgggctgtgcgatcacagccactgcctttctcctgggagcctccacttcctccaaaacgggccttgtgccagccccacccgcggcgagcggacaaggccacgaaggcagggccctgagtacctgggcgggggggacactcccagggggcacagagggggctcccacctgggcacctgcctcctgcccttctcttcttcctccacgtgccaggtggggccctgggtttgaggagcctcggacgcgtgccctgcccgcaggaagctggaggcgtgcaagtggc

SEQ ID NO: 294739 - DNA, 632 bp, Homo sapiens
gcggccgcaagaacagtagccgcccagggactaagggggcttctgggaggacacacggctggcccagggcgaggggtgtcactgcagggcgccccccaggcccagggcccgtcaggggtcatgggaccgccctgaccacagcccccgtctgtcctagtgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagccgtgcccccggctctgctctgatagatttacagtatcaaactggaaaagaaagattgttacgaaaaatctgtagataaactgtgaatataattttatatctctata

SEQ ID NO: 294740 - DNA, 1049 bp, Homo sapiens
cttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagctgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttctaccgggtcttggcttctgttcccgcagggcatgagcctgaggagcaggacgcggtgggggtcacaggaggctgctgctcagagtctgcatgcgggaaaggggtcccacctgtctggggtgggcagcctcgtggtccagggcagtgcagggcagagcctgggctgtgcgatcacagccactgcctttctcctgggagcctccacttcctccaaaacgggccttgtgccagccccacccgcggcgagcggacaaggccacgaaggcagggccctgagtacctgggcgggggggacactcccagggggcacagagggggctcccacctgggcacctgcctcctgcccttctcttcttcctccacgtgccaggtggggccctgggtttgaggagcctcggacgcgtgccctgcccgcaggaagctggaggcgtgcaagtggc

SEQ ID NO: 294741 - DNA, 817 bp, Homo sapiens
cttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagctgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaagacctcgctcccttctacaagcaccgtgggcgcctggacctcccctctcccgga

SEQ ID NO: 294742 - DNA, 718 bp, Homo sapiens
ctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgggacgacttagcttctgtattattgttgcttcctcagggggagacagtcaagaataaaaagtattctaccacc

SEQ ID NO: 294743 - DNA, 2222 bp, Homo sapiens
cgccctgcaggctccgcgccgggcccagatacccgatcctcggtcgcgcgggtcgcccccgccccgacctccccggctgacgcgctctgcggctcggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccgtggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacc

SEQ ID NO: 294744 - DNA, 515 bp, Homo sapiens
ctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtggggctcccgacccccaccccggccgaggggcaacaagcccagtcccctctcacaaaagatgaaaccactggggcccagagaggggaaggacgtttgcgccagaattaggacccggacccagaacctaaatgatgtaatgagtccttcattcgtttctctaccaaatatgtaagtgaataacaacaagtgaataaagaggcaggtttaaaactcagccgg

SEQ ID NO: 294745 - DNA, 2237 bp, Homo sapiens
ctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccgtggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacc

SEQ ID NO: 294746 - DNA, 897 bp, Homo sapiens
ctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgggacgacttagcttctgtattattgttgcttcctcagggggagacagtcaagaataaaaagtattctaccacctctctgcctgacttggtttcctgggatttatccctgaaagaaaacctacatctcccctaagacatcaaaggacactgggcagtaagcctcagcagacagcagagagagaggccaccctaggcaagggggcatgcctgtctcaagtcggcttctaagaggctcatgcccaagctccagag

SEQ ID NO: 294747 - DNA, 171 bp, Homo sapiens
tctgccagcactttgaggccgtgcactctggcaccccagtcaccaacaacctcctggagaaatgcaaaaccctcgttagccaaagcaacgacttaagcagcctcagagcaaagtaagtccctctgatgctgctcttgaggccccgtgtgtgcctgtggggaggcctctgtc

SEQ ID NO: 294748 - DNA, 1663 bp, Homo sapiens
acgagggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccaggtaaggcgcacggagcctccctggactcgcggtgcgatcgctgccccggcggcctccccggcctcgctctcggacgccccttgcccgagccccagcccggcgcaggtggctcggaatccccacccggcagctcccagcgccagagggctgagcttcgtctcgctgggccgctccgttccactcccccaccccaccccacaccccggcagacacagccacccgccatcacagaatgctctagaagtcccttccgtgccacggtgttgccacggaagacgtggagctccccgcccggggcccctctcggaggaaaagtgtcgggacgtttttggctctgagcatctcagcgctcggtgcgggagccgcggggcgctggaggaacctgtgtgagagccagccgcagtgagccccaggcagcgccgtccttccccgcctgcctggccggggctccgcctcccgtctccgggctctgccgggccctcggcggggtgtcctgaaggtgcgctcccggcgagctgcccttgtctttggcacagagggactttttttgcccagtgtgtgcctgagttaaaaggggtcgtacgggtccttgtggcttctgctctgagggcttgtgttcccagcagacatctgacgtagagacctgcgaatggatctgagatgagtagtaacgcaggttgtccggggagagaaaccttttctagcgcggcctgggatgctttttccctccggcacacgcgctttctcacgggcttgattcctgcctacagattggggttccgggatatttgttgagcgtttacgataggcgttaatgttgcccaaaagaatcacttaaacaccaaaatgtagtagacgagaatccagatgagacacttgtcgcaaacattaaagatgaattttttttacagcca

SEQ ID NO: 294749 - DNA, 2212 bp, Homo sapiens
tgagcggattggccatttggagtggcactagagctgacgaaggtgccttgtggagagcatgcccgtgtgatagcttgtacgtagtggtttgtgatgacgtttgcttgtaagcggtgacttagttctgtctttcccattttaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgctttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagctt

SEQ ID NO: 294750 - DNA, 5349 bp, Homo sapiens
acgagggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcggagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgctttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagctt

SEQ ID NO: 294751 - DNA, 4276 bp, Homo sapiens
tgtcatcttgccttctcactagtagccatgttttcttcaccactcaccctccattcattttccttaggtaaaaaaacaattattatatttgttttctttattttaattttcctaaaaagttaatagtattgaatgcttcctgcagataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcggagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgctttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagctt

SEQ ID NO: 294752 - DNA, 4681 bp, Homo sapiens
acgagggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcggagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgctttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagctt

SEQ ID NO: 294753 - DNA, 1626 bp, Homo sapiens
  misc_feature (1614)..(1615): n is a, c, g, or t
acgagggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaaactgacacacagattgtaatagttgacgttgctcgnngatcctctaga

SEQ ID NO: 294754 - DNA, 2262 bp, Homo sapiens
acgagggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcggagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctgtttctagtcgtacaaccctgctcagtgacagtggtatcatggctatgcagtcttcattctgtctggcgtcggaca

SEQ ID NO: 294755 - DNA, 902 bp, Homo sapiens
  misc_feature (23)..(23): n is a, c, g, or t
  misc_feature (27)..(27): n is a, c, g, or t
  misc_feature (31)..(31): n is a, c, g, or t
cccggcgggcgccggcgcgcccncccnccancccacgtctcgtcgcgcgcgcgtccgctgggggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294756 - DNA, 1157 bp, Homo sapiens
cccacccgggccgcggcctacatacccagcccccggtccccgcccttcccgggtcaggccagtgcgggtgggccagcggacccggagggggtgggcggggcgggcgccggggccgggcggtcgctaggtgtgggaggctccctgggcgcgggccgggacgctgggcgcccgccttacaacccggcctgtggaggggtcccggggccgcagggccgctggtggcagtctctcctgcgccaccctggactctgcggggtgtccgactaggcttcggccgtcctccccggactgtgcgctcggcctcactccgccgctctccttgcttctctgcgtctcggggtctctgacactcggggtttctgcgccccgcccccgccccgcagacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294757 - DNA, 1449 bp, Homo sapiens
cccacccgggccgcggcctacatacccagcccccggtccccgcccttcccgggtcaggccagtgcgggtgggccagcggacccggagggggtgggcggggcgggcgccggggccgggcggtcgctaggtgtgggaggctccctgggcgcgggccgggacgctgggcgcccgccttacaacccggcctgtggaggggtcccggggccgcagggccgctggtggcagtctctcctgcgccaccctggactctgcggggtgtccgactaggcttcggccgtcctccccggactgtgcgctcggcctcactccgccgctctccttgcttctctgcgtctcggggtctctgacactcggggtttctgcgccccgcccccgccccgcagacgtgtcccgggcggttgagctcctcgagcggctccagcgcagcggggagctgccgccgcagaagctgcaggccctccagcgagttctgcagagccgcttctgctccgctatccgagaggtgaggggcgcgcggcgcaggggcgcgagctggtggccgtcgtcctcctcctcctcctcctgcttgtcccgagcccggagactacgcctcccggcagctcccgaggcggcccgccttggggtgccaacgcttcagctcaggggttcttcgggagttgtagttttctcggccttctgttgcgggggcggggcggatccttgcgtggtagcgggagagggtctagaggcctgaactcctgcgtctagggctggaggagctggcgactccctgatgccgctgcctcctcacccaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294758 - DNA, 1782 bp, Homo sapiens
cccacccgggccgcggcctacatacccagcccccggtccccgcccttcccgggtcaggccagtgcgggtgggccagcggacccggagggggtgggcggggcgggcgccggggccgggcggtcgctaggtgtgggaggctccctgggcgcgggccgggacgctgggcgcccgccttacaacccggcctgtggaggggtcccggggccgcagggccgctggtggcagtctctcctgcgccaccctggactctgcggggtgtccgactaggcttcggccgtcctccccggactgtgcgctcggcctcactccgccgctctccttgcttctctgcgtctcggggtctctgacactcggggtttctgcgccccgcccccgccccgcagacgtgtcccgggcggttgagctcctcgagcggctccagcgcagcggggagctgccgccgcagaagctgcaggccctccagcgagttctgcagagccgcttctgctccgctatccgagaggtgaggggcgcgcggcgcaggggcgcgagctggtggccgtcgtcctcctcctcctcctcctgcttgtcccgagcccggagactacgcctcccggcagctcccgaggcggcccgccttggggtgccaacgcttcagctcaggggttcttcgggagttgtagttttctcggccttctgttgcgggggcggggcggatccttgcgtggtagcgggagagggtctagaggcctgaactcctgcgtctagggctggaggagctggcgactccctgatgccgctgcctcctcacccaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtgagcccctgggtcaccacacccctggggcctccacgggctccctttaaccccaggctcccaaaccaggccagtgcttcctggatcttccagccctggcccctcctctgggatcctgacccttgacccttggcccaggctctcaccccaggctagtttggccaaatcccctggggagcccttagcttccttccatcccaagatacggaacctactgtggctgggatccctcagcccacttacctgggcccttgcctctgcaaccccagtcctgcccctcttgtctacccggagcctccctgatcccgggtcccttgtccaccccccttgcaggtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294759 - DNA, 728 bp, Homo sapiens
ggatcgtgcattgtgccatgacaagtgtcccatgcttggggatagtaacccaggctaaatcgctgtcctcggtccacatcccccaccccagctttcatgcctacctggaaggggccctcatcttcagtcgctttctctctcccaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294760 - DNA, 1025 bp, Homo sapiens
  misc_feature (23)..(23): n is a, c, g, or t
  misc_feature (27)..(27): n is a, c, g, or t
  misc_feature (31)..(31): n is a, c, g, or t
cccggcgggcgccggcgcgcccncccnccancccacgtctcgtcgcgcgcgcgtccgctgggggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaagagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtgagcccctgggtcaccacacccctggggcctccacgggctccctttaaccccaggctcccaaaccaggccagtgcttcctggatcttccagccctggcccctcctctgggatcctgacccttgacccttggcccaggctctcaccccaggctagtttggccaaatcccctggggagcccttagcttccttccatcccaagatacggaacctactgtggctgggatccctcagcccacttacctgggcccttgcctctgcaaccccagtcctgcccctcttgtctacccggagcctccctgatcccgggtcccttgtccaccccccttgcaggtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294761 - DNA, 484 bp, Homo sapiens
gtctggacgtttggccagggactgagggaacacggggctgtccctgacatgggaatcctgacccttgacccttggcccaggctctcaccccaggctagtttggccaaatcccctggggagcccttagcttccttccatcccaagatacggaacctactgtggctgggatccctcagcccacttacctgggcccttgcctctgcaaccccagtcctgcccctcttgtctacccggagcctccctgatcccgggtcccttgtccaccccccttgcaggtccttggagtctcgaggttgaaaccacagatctggacgttcacgtgcactctcttcctgtacagtatttattgttcctggcactttatttaaagatatttgaccctcaaaaccaaaacaacaaaaaaacaaacacaaaaataataaaacaccaaaacacacaccacccacccttctccccgggcaggcacccaacaccagcaacaaac

SEQ ID NO: 294762 - DNA, 519 bp, Homo sapiens
  misc_feature (23)..(23): n is a, c, g, or t
  misc_feature (27)..(27): n is a, c, g, or t
  misc_feature (31)..(31): n is a, c, g, or t
cccggcgggcgccggcgcgcccncccnccancccacgtctcgtcgcgcgcgcgtccgctgggggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaagaaatacaaaaaaaaaaaaaaagaaagaaaaagccgagcgtggtggcgagtgcctgtaatcccagctggattacaactccggaggctgagacaggagaatcgcttgaacccaggaggccgaggttgcagtgagccgagatcatgccattgcactccagcctgggcaacagagtgagacttcatctcaaaaaaaaaaaaaaa

SEQ ID NO: 294763 - DNA, 479 bp, Homo sapiens
  misc_feature (23)..(23): n is a, c, g, or t
  misc_feature (27)..(27): n is a, c, g, or t
  misc_feature (31)..(31): n is a, c, g, or t
cccggcgggcgccggcgcgcccncccnccancccacgtctcgtcgcgcgcgcgtccgctgggggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggtgggccccgcaccccattgctcctggtgtctatttaactgcctagtcgaactcaatatctccttcatgccagtcatttctgtttcctccctcatgatttttgctaaatctatgtgccaccttactattagtaaataatcgcacatttttaacttaaatg

SEQ ID NO: 294764 - DNA, 1144 bp, Homo sapiens
gagatgccaagtgggtattgactgctccaggatgtggatggagggtgtgaaaaccagggtggggtgacgcaggctctgggtcatgatagggagagcaggcagctgggtcctgggctggaggactaaaataagggacgccaccttcaggggtgacacatcagcccaggccctccctacgggtttgaccagtcctgttctgacggtattcctgcgccactgggctggtccctcctccactcctcccctataaagcctcctggggtccccaggcacccagactcagcccaccccagctttgggggccagtacgcagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaac

SEQ ID NO: 294765 - DNA, 3490 bp, Homo sapiens
gcgcgcagctggttcccgctctgcagcgcaacgcctgaggcagtgggcgcgctcagtcccgggaccaggcgttctctcctctcgcctctgggcctgggacccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgaaatgcattaaattaggaaaaaacatgaagatacattccgtggaccaaggagcagagcacatgctgattctctcatcagatggaaaaccatttgagtatgacaactatagcatgaaacatctaaggtttgaaagcattttacaagaaaaaaaaataattcagatcacatgtggagattaccattctcttgcactctcaaaaggcggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtaaagatgatccatcccttattgaaggactagacaatcagaaagttgaatttgtcgcttgtggtggctctcacagtgccctactcacacaggatgggctgctgtttactttcggtgctggaaaacatgggcaacttggtcataattcaacacagaatgagctaagaccctgtttggtggctgagcttgttgggtatagagtgactcagatagcatgtggaaggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttgaaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcaaggagttaacccaaaaggactggattactaacatgataaccacctgcctcaaagataatctgctcaaaagacttccatttcattctccaccccaagaagctttagaaattttcttccttctcccagaatgtcctgtgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaacctccctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaaaaaaaaaaagtcttatt

SEQ ID NO: 294766 - DNA, 2416 bp, Homo sapiens
tgttacttgtttctgaaagcttagtggtgacctcaagtaacaaaatctactcatttcttgtaggaaaacgaacagagttatttccttaagcagcataaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcaaggagttaacccaaaaggactggattactaacatgataaccacctgcctcaaagataatctgctcaaaagacttccatttcattctccaccccaagaagctttagaaattttcttccttctcccagaatgtcctgtgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaacctccctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaaaaaaaaaaagtcttatt

SEQ ID NO: 294767 - DNA, 816 bp, Homo sapiens
tctctaatatccaccgctcaggagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaaaaaaaaaaagtcttatt

SEQ ID NO: 294768 - DNA, 170 bp, Homo sapiens
cagctggtacgccccggatttagggataagagggtttactggccggttagaacccgtgactgtattctctcccttggatacccctatgcctacatcatattccttacctcttttgggaaatatttttcaaaaataaaataaccgaaaaattaaaaaaaaaaagtcttatt

SEQ ID NO: 294769 - DNA, 212 bp, Homo sapiens
tcccttgtttcctctgctcactgagactaaatactgatgttatcatttatcttcagtggtgcatataaggttcttttcataaatgtgacctgcacttataagcagaaccagtttattctgctttccaaatttttacttagagagggccaatggtaaaatgaagtgtaatatttctgtttctgttttcctagagtaaaaaacataaagcttat

SEQ ID NO: 294770 - DNA, 325 bp, Homo sapiens
tacagaaatgatgcctgtttatttggacttaaataaagcaagaaacatcttcaaggagttaacccaaaaggactggattactaacatggtatcttcagattgttatgtggagaaagaaaatacaccagaatatttcttaaaagaactcaaaatttcagaagaaatgttttgtgttaagggattctccgagaccttgtagcatattcagattaagttaaactcagataacatttaggagtttgcccttttagggtgaaatagttggcatagtagtcacacaggttacagatattctaaatagtgtgtctgtacacaaacacacata

SEQ ID NO: 294771 - DNA, 589 bp, Homo sapiens
atggagaagtacgagcggatccgagtggtggggagaggtgccttcgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggtgggccagcctccttacagtggcctggctggagggcctcttacctctgggacaggcagacacagatctcctggcttccctccttggaatgggcatggcaagggttagagttctggtcccaattatctgaccccggctagccccttgtcctctctggtcccagtgccctgttccatacataaaaggagaggggttgttggctgggcacggtggctcatgcctgtaatctcagcactttgggaggccaacgccgaggcgggcggatcatgaggtcaggagatcgagaccatcctgtttaacacggggaaaccccgtctctactaaaaatacaaaaaa

SEQ ID NO: 294772 - DNA, 1467 bp, Homo sapiens
  misc_feature (1144)..(1144): n is a, c, g, or t
  misc_feature (1149)..(1149): n is a, c, g, or t
  misc_feature (1152)..(1152): n is a, c, g, or t
  misc_feature (1154)..(1154): n is a, c, g, or t
  misc_feature (1163)..(1163): n is a, c, g, or t
  misc_feature (1170)..(1171): n is a, c, g, or t
  misc_feature (1173)..(1173): n is a, c, g, or t
cgacacaatggagtgagcgaaggagacgagcaggttgtgccagcgccaggtgcgcagggggtcggcgcgcacgtgcacgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctggggcgtctcatcctgtgaggaggcccacccctaggtgcaggacgaggcagactccttacngaggnacngnagcagccanagcccanntncaaccgacgaaccagggaagaccagaacggggtgacaataaagacggtcgacagtggggaaccacaacacgacgggccgaaggaaaacaagcacacacccaagacaaatcgcgaagcgacaaacagggggccaaagcacggcggcagcccctgaaaacacgagccaacacaggggacgcgcaaccgcgacaaaacaggtacaccccgtacaagcaacaccgaagaaaccgatagagaaacaaccaatacgacgaccaaccagacagggtgaagaggcaacaacacaccagagac

SEQ ID NO: 294773 - DNA, 1223 bp, Homo sapiens
cgacacaatggagtgagcgaaggagacgagcaggttgtgccagcgccaggtgcgcagggggtcggcgcgcacgtgcacgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtgcctgggcatggaagggacctccagggcactagaagtcttgagggccaggacctaaccctgcctcctcccctccccctaaaaaacccttggccctttggcccctgtttgggtggttctgcaggaggaagccccttggcttgctttgagaagaagctgtccccaaatgggcttatgcacagagcccctggtcttccctccctgcagggctgtgatcccagctcagcttctatcctgcaggatagaagctgggatcagtggtgggtaccccatgctatatctcccctgagctgtgtgagggcaagccctacaaccagaagagtgacatctgggccctgggctgtgtcctctacgagctggccagcctcaagagggctttcgaggctgcggtgagtgtatgcaccctccaggggacaactgagaaatctactgcctcgcccagcagcccttggctcaagccacctcaggtttctcctctagctgagtcatgtctctcccttatcagattaccccaggggagggctatgggtgtccctcagactatggatttctgagagtaggtcttgcctcccattagacggagggctcctgagggcagggctgtggctttcccagaagaccctcccaagagcaagacttgagttttcccagcatgctggggtttctgaggatatagctgcagctcccctatcagactagggatc

SEQ ID NO: 294774 - DNA, 593 bp, Homo sapiens
ctcgtagtccagcgacctgagggcaaacaggtggccgttgtccgcgttgatggagaccagggaagagaggggcagccacagaatagcgtcttgactcggacccagccagagaccctcccagaaaaacaaagagaagcaagacttgcctttgtctaagaaatcgctctcctcccgcctccattgcactttccgtcacgctcttccagggaatgtcgccaagctgaacctcagacagagctgggaaacagtcttttgccccacaacctttgtagacggcctagtgaataagcctttccagaggctcagacttgctggctcaaaaatctgcctgggctctcaaccgctggtttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctactggaggagtttctcatgttatatgaattaaataaatgcaatctagggaaataaaatgcacttttatctacgagcaaaga

SEQ ID NO: 294775 - DNA, 446 bp, Homo sapiens
tgttctatcgactaaggattctcgattgaaatacaaaacattcagagccacacaactactttccagtactgttaatgaaacctaagccatccctggatttgatattttgcccacaacctttgtagacggcctagtgaataagcctttccagaggctcagacttgctggctcaaaaatctgcctgggctctcaaccgctggtttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctactggaggagtttctcatgttatatgaattaaataaatgcaatctagggaaataaaatgcacttttatctacgagcaaaga

SEQ ID NO: 294776 - DNA, 771 bp, Homo sapiens
ctccgtgtgaggacccacctagaagtcaccatctatgaagcaggaagcaggccctcagcagacatgaaatctcctggtgctttgatttggacttcccagcctctagaactaggccaagaaacttgaaaaagtgatagaagcagggtaccttttgcatcatcaaacacagctcaggtgtcttctgagaagtcattttgatacagtatgaattcaataagacaagtcttccattgagcatgcttgggcgtactggtgaggaatcacctggggttgttaccattgagaactagcagaacagtaaccatcatttgctccaatgacacacggtgcatctcttatgctattagaagcaggacagctggatataagcaaccagcaggtacagctggaatagaaaagatagacagtggattctttggcttcatccaagtgggctgaggattgaagtatttttccagtcatgttcttgaacacctactttcatggcatgctgacatttccagactactgaagatgtgatgattaactgatcctgcatttgatgaaaaaaaaagtttgcacattccaaaggagataggtttcaaatgactatatagggtacaatttccactgaagtgatttctcttaatcttaatccttaaccactctcattgctacagtaccttccaaaaattaggagccggggagggatgagaagttaattgagctgagcatctcaggaacaggaagtcacagctgagcagcgagagttgattccaccaagaaaagaaa

SEQ ID NO: 294777 - DNA, 632 bp, Homo sapiens
ctccgtgtgaggacccacctagaagtcaccatctatgaagcaggaagcaggccctcagcagacatgaaatctcctggtgctttgatttggacttcccagcctctagaactaggccaagaaacttgaaaaagtgatagaagcagggtaccttttgcatcatcaaacacagctcaggtgtcttctgagaagtcattttgatacagtatgaattcaataagacaagtcttccattgagcatgcttgggccaggtacagctggaatagaaaagatagacagtggattctttggcttcatccaagtgggctgaggattgaagtatttttccagtcatgttcttgaacacctactttcatggcatgctgacatttccagactactgaagatgtgatgattaactgatcctgcatttgatgaaaaaaaaagtttgcacattccaaaggagataggtttcaaatgactatatagggtacaatttccactgaagtgatttctcttaatcttaatccttaaccactctcattgctacagtaccttccaaaagtaagcatagttcataaagtcttcagactgccttttagcacattaacatactcttcacaatcccacaataaaagcaccttaagtgcaggga

SEQ ID NO: 294778 - DNA, 480 bp, Homo sapiens
ggaaccttcccccagtatctgcattggcctccagtgtggtcggtgacatgggcaccttctcagagcacatatccagaactcgagatgggtattccaggtacagctggaatagaaaagatagacagtggattctttggcttcatccaagtgggctgaggattgaagtatttttccagtcatgttcttgaacacctactttcatggcatgctgacatttccagactactgaagatgtgatgattaactgatcctgcatttgatgaaaaaaaaagtttgcacattccaaaggagataggtttcaaatgactatatagggtacaatttccactgaagtgatttctcttaatcttaatccttaaccactctcattgctacagtaccttccaaaagtaagcatagttcataaagtcttcagactgccttttagcacattaacatactcttcacaatcccacaataaaagcaccttaagtgcaggga

SEQ ID NO: 294779 - DNA, 1026 bp, Homo sapiens
ccaaaaaagagacccggtggagcctcccaggggggaacatcagagccacagggcctggacgctgcatcctgggcccagatccaccagaagctccgggacttctcccgcagcacccaggcagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaacccaacacacaaacaagaggggcaggacggacaaaagaagatatccacctacggaggtggccaaaggatatagaagagataacacaaaggatatacttgttaccaaagaggtggcaccgatacacaaggcacagacctcgaacaagctagcaacacaggggatagaagcaacacatggggcacggcagcacagattgagacacacgccgccgcgaggatcacgcgcgcgcaacaaaccatacgtggccgaacccacgtaggcgaccgacactcccactagtactgaacggcggacaccccagacaaacaccctaggctgaggagagtctagcgcacacatccacactaggggagcagagaacacgcacaccctacgaaccgggacgcaccgtcactgacgggccgcgcaccacggcagcacgcgacacaagcccacgagagggaaaagggggcgccacacgaccgccgaatgaacaccggcaccccgcggcaccagacgaccgggccacaggaccgggcacgagccatcaggcgcgagacagaggagggggaatagttcgactaaatagagcagacaccagacattccatcaccacacgcggcc

SEQ ID NO: 294780 - DNA, 891 bp, Homo sapiens
agcggagcgttggtacgtgctttggtgcagggcctcttctcgagcgctgatttccagggtgctgttccagatgccatatccaaaataaatgagcagacctgtggggcgaggggaaagataagtaaactgaggcccaaagaagttaagtaaatttcccaaagtcacaagacaaaggaggggcagagctgtgatttgaagttggtgctgtttgactccaaaggctgtcagcttctttgggcaaagactgagtcatctctgcattctcagcacctggtgcaatttaagcagaaatatcttgaagatttttcgtatcttcagggagattaggaatgggaatggaatgggaacgccaatgcaggaaggatgagaagagagtgtctgcagatctgataataactgtaaaataacatggccacactgagatacagagggaaggttaagcctccttgaacttacttaaattggtggcagcacgagctttcagcatcatggccagcatgaccaagccatttccctggtgttcccctcagcatgaaacatctgtctacttatttctttgctgagcctgaatggaatattccatctctgaaaaataaactttgtgtttaaattgaaatctttattcctatctggcaaattggctatatatcctcaacaattggaaggaagtgatgtatctgctgccatcagctacaaagcactggacgcccactgtgctatttattagatttacatgaattccaggtgaatctgatccagtggctacaaaaaaagatctgaaacttctataagcccagcatctaaatcattttttgactgaaatgagtacaggcaagctctgaggcagctctatccagggctatgacaagaatgaagtgaacacattttacc

SEQ ID NO: 294781 - DNA, 731 bp, Homo sapiens
ctggaaaccatcatttatttttggtaaatgccagtgaggaatatacacgtcattcctgcagaaaagtctatagcatttaagtcttgaaaacaggtgacaattgaaaaacattataatattttcaggtcttttaataattcaatgctctgtgtccttcaggctgtgagaccctaaggtattggggtctggtaatgtcccagctatagcaaagggcctgttgggtgacataggacaaatatacagcaaaattcagaaactgcaagtgcttcctcacttgaacggatctggcccctttgtggtaggggcttgactgttcctagaatgaatgacttaaaataaggtggttaaaaattctgcagtgagtctcgccatggtgaacaaacatgattcagaaatgcctccttctataaaatgaaggagctgggttggagtcagtattaccagccagaccataccctgatgggtaaaggaaattctctaccacagagctcagcagtgaggtggctgagaggaaggcaggcctgcagatgaaagcgtgggagtggagcatgtggggcgggcactgtccggctgggaaaacccagccttcaagaggccattgtcaatcaggctgggcacggtggctcatgcctgtcatcctagcactttgggaggccaaggtgtgagccactgtgcctggccggggaactttgtttttaaacgtttacaaacaaaaagattttcgatgcata

SEQ ID NO: 294782 - DNA, 1194 bp, Homo sapiens
ctgctggtctcattgtgtcagggatagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcacaagcttatgaaaactaaacatgatgaatcaaaagcacttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgtatttgtaaat

SEQ ID NO: 294783 - DNA, 735 bp, Homo sapiens
ctgctggtctcattgtgtcagggatagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggcctccaggtttcgttcccgggggaatagcctttcttctttaaccttcccctgggaaggcaaccccaaatttcccctggggaatttcccaaggttcccaacttggggccttcaaacgccgtattttaagggaaaca

SEQ ID NO: 294784 - DNA, 395 bp, Homo sapiens
cggcacgaggaggaagagtgtaggtgttggcagtcattcagtatgtgtacttgtacaagttatttaacccattggagcctaaattccctcatctataaaatggggataatattatctacctcacaagcttatgaaaactaaacatgatgaatcaaaagcacttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgtatttgtaaat

SEQ ID NO: 294785 - DNA, 1136 bp, Homo sapiens
ctgctggtctcattgtgtcagggatagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcacaagcttatgaaaactaaattctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgtatttgtaaat

SEQ ID NO: 294786 - DNA, 858 bp, Homo sapiens
ctgctggtctcattgtgtcagggatagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaatcactctccgggtgtaccgtacgctctgaattcgtacatcgctggtcattagc

SEQ ID NO: 294787 - DNA, 664 bp, Homo sapiens
gtttcagggaagggttttcactcattggtagcaaggactggttgaagattgtaagacgcgtggattgtctgttgtttggaacaacgataaaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggatcccaccagcactcagaacaacagcaagtgtgtgtaacagcgggcacaggcgctccagacggaaggacctcactgacgcagttagctcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaacaccttt

SEQ ID NO: 294788 - DNA, 585 bp, Homo sapiens
tacagtggctcagaagaggctctgaagcaattccgatgtttaaccattccccttgataaatcaaatcacaaggacaggtaatggcttcctagagaggctgactttggaaagaagagaagcatgagcagtaaagtattgataaagtgatactcttgtaaattgctagtaaaaaaaaaagatgatatatgtatctgcaaaatccaaggaagttgcaatttgaaataaaaaattcttgaacagcaaaattgaagacaaaagaaccaaagaccctatttcagggtagactgaatcaagtcttcttgcactcactaaagaaaagacttgcagccatatgaagacaacagcaaagtgaccctgaccattttcttgtagtgacacctccgcatagtgacagatgggctcccagaggagtggattggcaggtcttgccagcacactgtgagttgatcacaagaggaaatcaggcctcacacctgtgctgaaccgagttccaggcacttctctaggtcctgtggaaaaaaaaaagtcatttgaatttctcttcctatagacaataaaggttattaaaaaaaatttctttccatt

SEQ ID NO: 294789 - DNA, 572 bp, Homo sapiens
tagcggacatttgcaaaatgacggtgctaatactcctcgtagtggtaatggtgatggtgctttgttgatgaagatgagtcttgcaggcagttttcattcccaaatattcaatatagctaagacaagatagaacagaattcttttgttatcctggaagccactggcctgtgggtggagggcatggaggtatatgaggtatatgtcttgtgggcttccagatgccaactgcaggtagaagactttggcatgtagatggaaagcactgcgctttctatccacagtgccatattctcagtcacttgggtcctgcccttcctgttaagcagcaggaggcaggctgcttgtgccctctttaccatgggttatggctcagacatacacattgtagtatattatttggctcatataaggcctgaggctcaaaggctacttcaggagaagcagagagggcatgaaggggctgtgcagcctttttagatgagggtgctatggggttcagtcaggatctttggttaggctatattgatcagctttggctgtggtgctcttctagcaaatgtcgctggtctaag

SEQ ID NO: 294790 - DNA, 467 bp, Homo sapiens
agcagtccgaatgggcgtcttctgcacagtcttccagcttccagggagcgtgtgtgttcaccaaggccgaatgctacaagactagggaaacttgtagatcaatgagctttgctgtagggtgggtgagaaattggcttctatattttcccaagtatctgaaacgccttcctctgcctacgccatcgtggaagtctttcaactctgctgaaagtctcaactggacttcctggcaaacttcttagccctgagtcctccacccagcccttatgacagtcccccaaagcaacattcaaatagcctctcgtagtttcaaacttgagaccctcaattctgtattaagaaagattcatttatcccaggctaccatatgcttttgcatggtaaatcgtaactctaaggagagctctgatggccagagtagttcagtaactgcaatgaacctgttagtgtggtatgaagagtttcca

SEQ ID NO: 294791 - DNA, 1762 bp, Homo sapiens
atgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagaaacaggatctcactctgttgcccaggctggagtgcagtggcacaaacacaacttactgcagccttgatctcccgagctcaagtgatcctcccatcttagcctcgcagaacactaagattatagatagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaaaaaaac

SEQ ID NO: 294792 - DNA, 630 bp, Homo sapiens
atgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagagtgagctcagcgatggcatcgcgatgctggtggcaggcaatgaccgcgtgcaagcagtgatcacacagatggaggaggtgtgccagactatcgaggtgagcctgggctggagggag

SEQ ID NO: 294793 - DNA, 1195 bp, Homo sapiens
gcacctgcttgcccctacgaccttgggcaagtcaccccctctgagttcgttttctgcttaacgaattgggacgtgccttcccacctaccccgcaggactgtggtgagattcagaaatgggactttgcccaggttggcccagtgcttactctcaccctccttttcttccctgcagcaggccaaggagctgatcaataagtgagtaggcatagcgggaagggaaaggagggggctgcactgctccactggctggggtggggcttgagagtgctggggcattgccagctgagtccgtgtggccactgcagggtcggggccatgtcgaaggtggagctggcagggcggccggagccaggctatgagagcatggagcaattcaccgtaagggtggagcacgtggccgaaatgctgcggaccatcgacttccagccaggtgaaggaggtggccgagggccgctgagacgggttcggaccctctgtgtggggggtgcggcgggcacgatggccgtaaaggcagggactccacctcaccaggccttccttgggctcaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaaaaaaac

SEQ ID NO: 294794 - DNA, 1422 bp, Homo sapiens
  misc_feature (25)..(25): n is a, c, g, or t
tagtgatctagaggatcccgctgcncctactactaccgccgtgtctggtatctggtggatgttggagactgtctgttccttccccacttagtggtggagggcttctctccacctccttccagaatcactagaatgtgcttccgtacctcttgatggttcaagccttctagattgctgtagatgcccttatggggggtgaggtggaagggccagccctctcctaggcaaccctggctggggtgaggggtgtagctctaggccaggtcccagctctgagtgctgacctgtgtgtgtatcagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaaaaaaac

SEQ ID NO: 294795 - DNA, 1636 bp, Homo sapiens
atgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaaaaaaac

SEQ ID NO: 294796 - DNA, 1180 bp, Homo sapiens
aaaagatctgggctgggttctggctcagccactaactcacagtgtcactacggatgggtcactttctgtgttggttctctgtgagtaccctgtgctttcccagccaccgggtctcagccacgccttccctcatccttgctccccatcttttaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaaaaaaac

SEQ ID NO: 294797 - DNA, 552 bp, Homo sapiens
cgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggtgggtgccagggacgggcagggccaggtaaagcaatgcagacctgtgggggactgatcaggtcagagctgagaccccagaaggtgatggatagagtgctctctgaggtgggtggtggctgttgtggctggagagcagaagggctggggtccaagcaaatcccagagcaagcatgagtcagcagctccctgcaggctggcaggtacagcctgtgcatagacggcagctggagtgctgggatctaccaaggaaagtagaccctgtggaaactgggagggagggtatcccacaccgggctttataagagcctgtgccagactctgcattccagtttggagtttcagacttcgagagcattgtggaaaatacggagaaaagattaatgagataatgaaacgttaaaaaacaa

SEQ ID NO: 294798 - DNA, 1017 bp, Homo sapiens
taattgctttctttcctgcctggggtttttcaaggttccccccggctttgggtaagggagctctctcagggcttgatggctttacctttgtcgtgtgcttcttgcccagtgtccccacacaacgttgcgcttctccgtggctgcatttagactttaccgtaaatgtgagtttcactgctcacacattgccccccatattatcttccccagagagcaggaggcacccagtattcccacctccttacaacagtgccttgcacagaacaggccctgcgcggatgaaacttagcaaggagagagattcttcctgttgtatcaatataagaaacgggttccaggcctgcctgaatgagttccatacacaatgcattaatataattgttcatagttcctttcaacggcctcttaacaagttcccaaaatgagtattatcagtataatttaaaaagttaacacaaggaggagagatggctgacaataaaatagttatgtacttgatgacaatctgtaatagcttcaggtcggaaacaagtacctttccttttcttgaaacaaagttccagtctctggaacataaaaccgggaaatacatcaactttggggaacaggagaaaaactgtatttattctaaccgaagtactcctctcactttcaggcgtccagcgtctccagagcctctacaagtgcctccatcaaaccagcttttgggaaagaatctgttaagcccattcagctaagcggcacggggtcacagggctttgagtagccttcctcggtgacgctgagtagggaactccgggatggggctccacggtggactctcggggacaggcacccggggccaccctacaaagcctcgccctccaggccacagtccagagccttcggcctgcgcagggtcctcgctgcatccagcggacggtactgagaagccatgcgctggcggtttgatgcaacacgaccctcagggccgacccagcgagtgaccaaacatagcatgtttttgttttgcaactc

SEQ ID NO: 294799 - DNA, 461 bp, Homo sapiens
cagtcatgcttcctgtaaagcctgcagtaatgtggcacagcatgtgcagggctggaaggccgaggaaggctgtgcaaggctgtgtcagcatcaaggaaggcgtccagcgtctccagagcctctacaagtgcctccatcaaaccagcttttgggaaagaatctgttaagcccattcagctaagcggcacggggtcacagggctttgagtagccttcctcggtgacgctgagtagggaactccgggatggggctccacggtggactctcggggacaggcacccggggccaccctacaaagcctcgccctccaggccacagtccagagccttcggcctgcgcagggtcctcgctgcatccagcggacggtactgagaagccatgcgctggcggtttgatgcaacacgaccctcagggccgacccagcgagtgaccaaacatagcatgtttttgttttgcaactc

SEQ ID NO: 294800 - DNA, 1965 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294801 - DNA, 1078 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaactaagccacccagacaccatcatcccgaaaaccccagcccttctcccatggcaggtaagtgcgcgcaagtctgggggtctccgttatccccccacggacttgggagccgggtttgaacacatcctcccggaatgtgctcggactggctgggtggggcccctcccttccttccggggaacctccaccctgctcccctgccccatctttctctgcctcttgccaccacgtttcccccgaagcctcgcggcccatgggctgaggaataaggggatgaggccttgagtccctttctaatctatcctgctcccaccgctttacaggctacttgccccccaaaggctacgccccttcgcccccacctccctaccctgtcacccctgggtacccggaagcccggcgctgaaattccatggagcccagggacaaggacgccaagtagcgcacgcagcaaggctacctaggacacacacgatcaccaggctcacagacccatctttcacactacgcacatgggccccccggtgggacacattgtgcaggctcttgactgacgccccccatttcattgggaccaacatggctcaaggccgatgcaccctatactggggccctccgcaaccgtcctcgggtggcaccacttggacaccagcaatcatcgcaattcagcaagccaaatggctcgatcgccgaagctgggaaaaaatgga

SEQ ID NO: 294802 - DNA, 894 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaactaagccacccagacaccatcatcccgaaaaccccagcccttctcccatggcagctacttgccccccccaaggctagccttgcccactgctacctgtcacccgggtccgggcgggctaatctgggccgggagcgcaggccgccagtactcccgtccggttcgcctcttcctgcggcccgggcttgggttgtgccccttttgcatgcgggtgctttggctcattctgtgcatgatcgattgatccgaggcgggagtgagtcctggtggggctgttcggtatgactggctctggggccgggagccctgggtcaggcggcgagagacaatgtgcgccgtctgtgtgggcgcccgcggcgtggtgtcgctggcgaccgggacgtgaggtggttgtcgccgtgcctgggtgagcgtgccctgggctccaggatggatcagtccacagccaatgcagtgctcgacgatctctcccagtcctcagagcgtgcaacgctggatgggcctgcgtgtgttgacaccatgggag

SEQ ID NO: 294803 - DNA, 1768 bp, Homo sapiens
  misc_feature (21)..(22): n is a, c, g, or t
  misc_feature (24)..(24): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294804 - DNA, 2077 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294805 - DNA, 2333 bp, Homo sapiens
  misc_feature (21)..(22): n is a, c, g, or t
  misc_feature (24)..(24): n is a, c, g, or t
  misc_feature (2271)..(2271): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaagatgtatgtaataggggagggtagaagcagttggtatgggaaaaaacaaaggggaatgtgagagctgggctggggcaggggctagtccatctcataatccatactaccagcatcaaatgtccttgagtgcaagagagcaatcgtcatcacccacgatggccctggaccaaacgaaggcagtttgggcctataccccaagtcaatatggtggcttccatcatccaggatggctgccctgcagagtccagtgtggtagctgatggcagttcaggatggctgttcacatggtccagtgtggccccttgatcctctctagcgcgtagaagcttcctctgcatatgatgtatagcagctcttttcctccaagtcctcttgtttgagaatgtagtgggcagactagatccttcttggcccagccaaaggagcttcagccttcagaagccaaggagcatgggagggaggagacatttgccagtgcccaacttctgggctcctcctcccantgtgcctacggcaggttgggatctccccaggtggaacgtcttacccctgtcgggaccttgtt

SEQ ID NO: 294806 - DNA, 1855 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294807 - DNA, 2005 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294808 - DNA, 2283 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagttcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294809 - DNA, 1793 bp, Homo sapiens
  misc_feature (22)..(22): n is a, c, g, or t
  misc_feature (43)..(43): n is a, c, g, or t
  misc_feature (80)..(80): n is a, c, g, or t
ccgctgtgccagggagagaagnacggcgaggtcgcccctgggnaggcagaaggcgagccaggagccagtcctggaagccnaatgatcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294810 - DNA, 2549 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagttcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggtaagtgcgcgcaagtctgggggtctccgttatccccccacggacttgggagccgggtttgaacacatcctcccggaatgtgctcggactggctgggtggggcccctcccttccttccggggaacctccaccctgctcccctgccccatctttctctgcctcttgccaccacgtttcccccgaagcctcgcggcccatgggctgaggaataaggggatgaggccttgagtccctttctaatctatcctgctcccaccgctttacaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294811 - DNA, 2082 bp, Homo sapiens
  misc_feature (21)..(22): n is a, c, g, or t
  misc_feature (24)..(24): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaaaaaaaaaaaaaaaaaaattgtgtgggcggccagcgggcatggaaaaaaagttttctaagaccattcgttggggaggccaggcccccaggtagggtaaaggtggaccactgggcacacagcgtggccccaagggaaaacccggggccacggaccatagggtgtggggtttctcccccaatataaaaaacgccccggggcgaaacccgggcgtgttcttggacaaaactcccagatgggagttcggggggcacataacgggctctacacccggagggtccaagcggagccgaaataaaatactggcccagccgggg

SEQ ID NO: 294812 - DNA, 2047 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagttcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294813 - DNA, 2112 bp, Homo sapiens
  misc_feature (21)..(22): n is a, c, g, or t
  misc_feature (24)..(24): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaagatgtatgtaataggggagggtagaagcagttggtatgggaaaaaacaaaggggaatgtgagagctgggctggggcaggggctagtccatctcataatccatactaccagcatcaaatgtccttgagtgcaagagagcaatcgtcatcacccacgatggccctggaccaaacgaaggcagtttgggcctataccccaagtcaatatggtggcttccatcatccaggatggctgccctgcagagtccagtgtggtagctgatggcagttcaggatggctgttcacatggtccagtgtggccccttgatcctctctagcgcgtagccccacagagagacattcggt

SEQ ID NO: 294814 - DNA, 1825 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagttcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294815 - DNA, 2286 bp, Homo sapiens
  misc_feature (21)..(22): n is a, c, g, or t
  misc_feature (24)..(24): n is a, c, g, or t
  misc_feature (2224)..(2224): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaagatgtatgtaataggggagggtagaagcagttggtatgggaaaaaacaaaggggaatgtgagagctgggctggggcaggggctagtccatctcataatccatactaccagcatcaaatgtccttgagtgcaagagagcaatcgtcatcacccacgatggccctggaccaaacgaaggcagtttgggcctataccccaagtcaatatggtggcttccatcatccaggatggtgttcacatggtccagtgtggccccttgatcctctctagcgcgtagaagcttcctctgcatatgatgtatagcagctcttttcctccaagtcctcttgtttgagaatgtagtgggcagactagatccttcttggcccagccaaaggagcttcagccttcagaagccaaggagcatgggagggaggagacatttgccagtgcccaacttctgggctcctcctcccantgtgcctacggcaggttgggatctccccaggtggaacgtcttacccctgtcgggaccttgtt

SEQ ID NO: 294816 - DNA, 1743 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 294817 - DNA, 1320 bp, Homo sapiens
  misc_feature (21)..(22): n is a, c, g, or t
  misc_feature (24)..(24): n is a, c, g, or t
ggctggtacggtcggagttcnngnatgccgagtgctaggcacccgggctcttctgggggctcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccccttccttcccttgccctaggaaaaaggctgcatctttatatgttacattcatataaactttgtaactttttggacattgaaa

SEQ ID NO: 294818 - DNA, 1624 bp, Homo sapiens
  misc_feature (25)..(25): n is a, c, g, or t
  misc_feature (28)..(28): n is a, c, g, or t
  misc_feature (32)..(32): n is a, c, g, or t
  misc_feature (1562)..(1562): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaactaagccacccagacaccatcatcccgaaaaccccagcccttctcccatggcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccccttccttcccttgccctaggaaaaaggctgcatctttatatgttacattcatataaactttgtaactttttggacattgaaagatgtatgtaataggggagggtagaagcagttggtatgggaaaaaacaaaggggaatgtgagagctgggctggggcaggggctagtccatctcataatccatactaccagcatcaaatgtccttgagtgcaagagagcaatcgtcatcacccacgatggccctggaccaaacgaaggcagtttgggcctataccccaagtcaatatggtggcttccatcatccaggatggctgccctgcagagtccagtgtggtagctgatggcagttcaggatggctgttcacatggtccagtgtggccccttgatcctctctagcgcgtagaagcttcctctgcatatgatgtatagcagctcttttcctccaagtcctcttgtttgagaatgtagtgggcagactagatccttcttggcccagccaaaggagcttcagccttcagaagccaaggagcatgggagggaggagacatttgccagtgcccaacttctgggctcctcctcccantgtgcctacggcaggttgggatctccccaggtggaacgtcttacccctgtcgggaccttgtt

SEQ ID NO: 294819 - DNA, 1013 bp, Homo sapiens
  misc_feature (951)..(951): n is a, c, g, or t
taggatccccaattagcttgcgacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaagatgtatgtaataggggagggtagaagcagttggtatgggaaaaaacaaaggggaatgtgagagctgggctggggcaggggctagtccatctcataatccatactaccagcatcaaatgtccttgagtgcaagagagcaatcgtcatcacccacgatggccctggaccaaacgaaggcagtttgggcctataccccaagtcaatatggtggcttccatcatccaggatggctgccctgcagagtccagtgtggtagctgatggcagttcaggatggctgttcacatggtccagtgtggccccttgatcctctctagcgcgtagaagcttcctctgcatatgatgtatagcagctcttttcctccaagtcctcttgtttgagaatgtagtgggcagactagatccttcttggcccagccaaaggagcttcagccttcagaagccaaggagcatgggagggaggagacatttgccagtgcccaacttctgggctcctcctcccantgtgcctacggcaggttgggatctccccaggtggaacgtcttacccctgtcgggaccttgtt

SEQ ID NO: 294820 - DNA, 1308 bp, Homo sapiens
  misc_feature (25)..(25): n is a, c, g, or t
  misc_feature (28)..(28): n is a, c, g, or t
  misc_feature (32)..(32): n is a, c, g, or t
  misc_feature (1304)..(1304): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgtgagttggctgcccctgcccccacctcctgcctgtcctttgctgtcatttgaagctttatgcatttcctggcctcttgctaggggaaagtcaggaataggtgttgtgggggttgaggttctagagctggcctgtgacagcgcaagctgggctggcccagccgngatc

SEQ ID NO: 294821 - DNA, 1330 bp, Homo sapiens
  misc_feature (25)..(25): n is a, c, g, or t
  misc_feature (28)..(28): n is a, c, g, or t
  misc_feature (32)..(32): n is a, c, g, or t
gggccagcgcggccggggccccctncgncctncccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagttcagaggcgccgcccaagagaccctgggccggcgccgggcgcagctgcctctccgtctttgtgtctgtctctgtgtctgtctggctatctccgagtttgcctccgcttccagaactaagccacccagacaccatcatcccgaaaaccccagcccttctcccatggcagattgatcagattttgattcaccagaaggctgagcgagtggaaagtaagtagaaggagtgggaggttggacctcatgatggtggcccggatggtgggctcctgggcgcgcgaggctctacgagtctccccgtgtcacctcgggcagcgttcctaggctgggagacctgtaatcggtatgaactgcgctctggggccgggcagcccctgggtcaggcggccgaggagagcaactgctgcgcccgtctgtgctgtggcgcccgccggccgcctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaaattccgcaagtgtgggcccgaatcagcaaagcagtgtagg

SEQ ID NO: 294822 - DNA, 626 bp, Homo sapiens
atgtctagggtattctgttggtggtatatttaccccggatccacagaatcgaccaagccccacagctgttgaatcaagaccatcaaagagctccacatagtcatagccacagtctgcttcttcctccacttcaaatgtctggaaggataattcaagtcgagagccccgttctgatactaatagccattcacagtcaacctgtcctgggtagttgttatcaccaaactgagcatcgtcagatatgttttccacaactggagagtcagatagtgtcatgggtgtccacccaggccccagacatggacgacctgggttggaatctcagtcccagtgcctgctggctctgtgactctggcccaggaagagctgcaggggaggacctggagatctggtacaggcagccttttgtgtgtctgcctcacagatacaagttagcaccacaaagaccaggatccagaagaagcaacccttcgccagccacagctgggaataaaaatcaaggaagaactgaagaaattaaacagaagaggaaaaatgagttcatagaggctttatgaatctgaaaatcactggaagttgtctttatggaactttattaaacacttctagaaaaatggcctacattt

SEQ ID NO: 294823 - DNA, 865 bp, Homo sapiens
tcttcaggtactgttgagtacaacgtgcggatatcccaggaaactgtggctgcctgaaacgaacaatgaaaagaaattgagtcctccggcttagaagtgtcgagcagaccagcacactgaacacacaaaaggctccaaaacatgtctcatctcctctaaagaggtgaggaccaaacattctacatatgggaagatgtgagcattaatagaaacgaggtgctccaacaatataaagacacctactgcaccaggacctccccctggcaaagactctgaggtctgtggtctgagtttaccatccaagaaagcccagtgaagagggttgcctgctgcgaggcctgcagacatggtctagggaagagaaatggactgaagagcggcccagcactgccagctctcaccggctccataccacctggctgcccgcatttctccttcagggccagcctcattcctgcacagggcctttgcccatgctcctctgcctctccaaaagtctttttctttcctcattctttagaaatctcaggttttgtataggtgccagctccttttcaaaagctttctaattcatccaacacacatttttcttccctgaatgctgttatttactctctgtagcacacatgaagtctgcagcttacccatagaatattttaggccgaaaggttatgctgctgatgaattcagccggtcattttacctgtgtgttttattgtttataagcaagccacattacatctgctttgggggtaaaatataacaactggaaaataagttttgccatgttccttattactcctttgctatgttccattcattccttttaaagaataaagtgctcgtatctacatatatgctttca

SEQ ID NO: 294824 - DNA, 940 bp, Homo sapiens
tcttcaggtactgttgagtacaacgtgcggatatcccaggaaactgtggctgcctgaaacgaacaatgaaaagaaattgagtcctccggcttagaagtgtcgagcagaccagcacactgaacacacaaaagatctctttaatgtgtctccactgaagcaaaaatgaattgatcgaatacaaagaaaactgtaaacaatcatatttggctccaaaacatgtctcatctcctctaaagaggtgaggaccaaacattctacatatgggaagatgtgagcattaatagaaacgaggtgctccaacaatataaagacacctactgcaccaggacctccccctggcaaagactctgaggtctgtggtctgagtttaccatccaagaaagcccagtgaagagggttgcctgctgcgaggcctgcagacatggtctagggaagagaaatggactgaagagcggcccagcactgccagctctcaccggctccataccacctggctgcccgcatttctccttcagggccagcctcattcctgcacagggcctttgcccatgctcctctgcctctccaaaagtctttttctttcctcattctttagaaatctcaggttttgtataggtgccagctccttttcaaaagctttctaattcatccaacacacatttttcttccctgaatgctgttatttactctctgtagcacacatgaagtctgcagcttacccatagaatattttaggccgaaaggttatgctgctgatgaattcagccggtcattttacctgtgtgttttattgtttataagcaagccacattacatctgctttgggggtaaaatataacaactggaaaataagttttgccatgttccttattactcctttgctatgttccattcattccttttaaagaataaagtgctcgtatctacatatatgctttca

SEQ ID NO: 294825 - DNA, 2644 bp, Homo sapiens
taggagtgaaggaaaggcggggacccggatgtgtgtggtggcggcggccgaagagcttgtgtgcggagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaagatggagtttccgtattta

SEQ ID NO: 294826 - DNA, 2217 bp, Homo sapiens
taggagtgaaggaaaggcggggacccggatgtgtgtggtggcggcggccgaagagcttgtgtgcggagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaagatggagtttccgtattta

SEQ ID NO: 294827 - DNA, 1091 bp, Homo sapiens
  misc_feature (1)..(2): n is a, c, g, or t
  misc_feature (6)..(6): n is a, c, g, or t
  misc_feature (11)..(11): n is a, c, g, or t
  misc_feature (19)..(19): n is a, c, g, or t
  misc_feature (49)..(49): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (70)..(70): n is a, c, g, or t
  misc_feature (73)..(73): n is a, c, g, or t
  misc_feature (328)..(328): n is a, c, g, or t
  misc_feature (344)..(344): n is a, c, g, or t
  misc_feature (362)..(362): n is a, c, g, or t
  misc_feature (364)..(364): n is a, c, g, or t
  misc_feature (378)..(378): n is a, c, g, or t
  misc_feature (415)..(415): n is a, c, g, or t
  misc_feature (417)..(417): n is a, c, g, or t
  misc_feature (437)..(437): n is a, c, g, or t
  misc_feature (443)..(443): n is a, c, g, or t
  misc_feature (452)..(452): n is a, c, g, or t
  misc_feature (455)..(455): n is a, c, g, or t
  misc_feature (459)..(459): n is a, c, g, or t
  misc_feature (471)..(471): n is a, c, g, or t
nngccnggcgnggtggcgngtgcctgtagtcccagctactcgggaggcngaggnagnagnatcgcttganccnaggagttctgggctgtagtgcactatgccgatcgggtgtccgcactaagttcggcatcaatatggtgacctcccgggagcgggggaccaccaggagctgactaaggctttggaacagaaaccagatgatacacaatattattgtcaaagagcttattgtcacattcttcttgggaattactgtgttgctgttgctgatgtaaagaagtctcgtgaactcaatccaaataattccactgctgtgctgagaaaaggnatatgtgaataccatnaaaaaaactatgctgctncnctagaaacttttanagaaggacaaaaattagatatagagacggggtttcancntgttggccaggctggtctcnaactcntgacctcangtnatcnacctgccttggnctcccaaagtgctgggattacaggtgcagatgctaatttcagtgtctggattaaaaggtgtcaagaagctcagaatggctcagaatctgaagtgtggactcatcagtcaaaaatcaagtatgactggtatcaaacagaatctcaagtagtcattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcaa

SEQ ID NO: 294828 - DNA, 1058 bp, Homo sapiens
  misc_feature (1054)..(1055): n is a, c, g, or t
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtttttccagagcttctcagatgctctaatcgaccaggacccccaggcggcgttagagtagagacggggtttcaccatgttagccagactagtctcgatctgctgacctcgtgatccacctgccttggcctcccaaagtgctgggattacaggcatgagccaccatgcctggccaaaaacccatctttttctacatagttgctgttgctgatgtaaagaagtctcgtgaactcaatccaaataattccactgctgtgctgagaaaagggtatgcaatagctactctttttgttgagcttggactgtaaataatagatgtttaatttgttgaatgagttcattgtaagctttataagtagtaaaattatttatacatattatagcagagatatgattcaattttaaatataaagttatagttctattattttgttaaccataatatgtgataggagatctatacttaatatattttaaaatagtgatgattgaaataactgcagggtatagatgaaactgatgcatttcacattccttttttgtttatcatttggaatttactctatttaactgactggtgaacatcctattattcaaccaagctgaataggctacatttaatgctatgaaagctctgtatctatgtgctttatatcccatcttgtttctgttgataagtgtaactttattctttaagtaagaaactgctttaattcctttgtataattatattttggaataagcaagtatgtataattaaagtgaaattccttctgaagtaagttctaaaattgaattttactggaaattatactagatgttaacagtattttagaaagtctcttggcttactaacatatgcttaaaataaattttttctttcaacaatagaaaaannaaa

SEQ ID NO: 294829 - DNA, 955 bp, Homo sapiens
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtttttccagagcttctcagatgctctaatcgaccaggacccccaggcggcgttagaggtgggagagccttttctgcttcctccactcccggctgacccgcctccttccagcaccgcctgattaggactcaggctctagtgatgctgcgtctcagccccagtattgagattctcggtctcctttctctctctcacggtagccgcgttacctcagactcctgtcttgccctttccacttccagactcttgcattcctgaagcttctgagaaaaacttcctctatttattgggagcatggttggcatctgcagttgggctgaaaggatttttttttttaatgactagaagagaaaagtggactctgggctcgatgaaaattaattttttcttttgacaatcattgttgccattcttatgtaaaagtgtcggtatgaagtcagtctactggaacaaaaacctcttccctcacgtcccggaaactttccagatgtcttgtcatagttcattattcactcatttgtttatttatcaaaaaattttttaggagttgctgtgtgcaaaggcgctcattgctatgggttagtcttagttatatacttagctaacctagagatcactgcttgtaggtgtgcagtgaagacaaactataaagctgtaaaggaatgtaaaagagcaagagttgataagagttgaagaagagcctaagctaaagataaatgatgctgtgggtcacagaattttaacaggagatcttttttgttttttgttttgtttgtttctttttgctttaaagcacag

SEQ ID NO: 294830 - DNA, 926 bp, Homo sapiens
gttaacttattcatcgactcattatttactgtgttattacctgtagagatataacatacatattatttattttaggtgaaagagcttatgatcctaagcacttccatattagggtcagtagaatcatgattgatgatcattatgtccccactctacagtaagttttatgctaagttgactatcagaagagggctaaatatattgggcttggttttctgaaaatattttaatttaactaaaaatattaaacttgaaatcagtaagatggtggtattctccaaggaagtaaatgagtggatgactcaagatcctgaaaacatcatagtgattcactgtaaaggaggcaaagtcttataaaatctgctttaggagacagaactgggcttgaagccttgtctttcaaagacaaaatccatgcaagaccaagtgttggagcaggcgatggatatgatctaaaagtcaaaatagtgatggagaaaaaggttgtcttttcctgtacttacttaagaaattgttaggtatttcatgacactgaaacagagcaataattgatgtattcaacagtccacctctgtatgatgatgtgaaagtgcaatttttctctttggtgagtaatcaagaaacagcctctgccattgttcttgtctggtcttttgaatgattttatttaagatttgctttactacacttcccaacaagggagatgacagatgtcatcccacagagggagggtgagaaaaacaataaatcagatttataacagatttttttaaaataacatatgtaatttgaataatttttgttcatttgttttttctaaattgtaaattttctaattttttctaaatttacatatattagttatcaaatacaaaaaatacaaaataaacacaaaaaataaaagccaagatgctaaaaaaaccaaa

SEQ ID NO: 294831 - DNA, 852 bp, Homo sapiens
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtgcagattttaatttcagtgactgaattaaaaggtgtcaagaagctcagaatggaagtcgtgcagtttctagacaagaagcatccaaaccactatcaagtctacaatctatgcagtatgtacattactctgtattttgctactgtagatagaaaacagattactgcatgtaagaaggtgattttgttttttatattgcatttaatcataagtgtgtagtggtggtgaggaatgaatttaaaaccccatcttggactggccccatttggatagaaggagttaacccagcagcacaaagtaccctatgaaggaggcagctctggcaggaccaatgatgctagagtggaggcaaaccattttagggaagatctgttctagtgatattaggtttaggaaaatctttctgtttttcctgccagattgggttatgaggacatagataatttaacaaatgagtcctctgatccatcagcagtgggttgtgatgagagcagggccctagatgggaaaaaaagcaaaaaactctgtagaaaataggttgtaacccagcttaccactgtctgtcttgatttttttcctctacctgtatactcaatagacattttcaggggggcaatcattttggtcagctacatttgcctcttgtgtgggttctaactaccctgcaataatataatgaatagtctgctagaaag

SEQ ID NO: 294832 - DNA, 760 bp, Homo sapiens
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtttttccagagcttctcagatgctctaatcgaccaggacccccaggcggcgttagagagctgactaaggctttggaacagaaaccagatgatacacaatattattgtcaaagagcttattgtcacattcttcttgggaattactgtggtagtttttcttataaagtatattgtccctttttaataagttacttatacattttacccatggccaattaatcaaataaaataaaggttgtctttgaggatttttaaattggtctttcatacaaggtaaagtagctcaagtgtgacagacatgttgaacaacacctatttaaattttatggatgtctctttttcctcagtgggtggataatgtatatagatttcattcgtagttattgggtaggctgataaagaattagtatcatatttactatttgacagagtattaaaatgaaatgctcttctttgtattttttttttataaaaaagaatgtggccaggcatggtggctcactcctgtaatcccagcactttgggaggccaaagcaggaggatcatatgaacccaggagttcgagtccagcctggacaacagagcaagaccctatctatacta

SEQ ID NO: 294833 - DNA, 767 bp, Homo sapiens
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggaagtcgtgcagtttctagacaagaagcatccaaaccactatcaagtctacaatctatgcatcttataaaatctgctttaggagacagaactgggcttgaagccttgtctttcaaagacaaaatccatgcaagaccaagtgttggagcaggcgatggatatgatctaaaagtcaaaatagtgatggagaaaaaggttgtcttttcctgtacttacttaagaaattgttaggtatttcatgacactgaaacagagcaataattgatgtattcaacagtccacctctgtatgatgatgtgaaagtgcaatttttctctttggctaaggaagcaagaaagtggaggggcgggcagagccagatccagtggtttcactcatgcaagacagaagtcactgtctatcctgtggctggaggggctactttgctcagaagacacaggtctttttaagtcatcaatgtgttgacaacagtcaactcactctctcgcctcaattccgcacgcacacatttacgctatctcctctctctcaactcacgtacctccccacatcaccgtctctccttctctctttttttctcttgctcttcttccatctcctctaccatctcc

SEQ ID NO: 294834 - DNA, 710 bp, Homo sapiens
tggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtatttcatgacactgaaacagagcaataattgatgtattcaacagtccacctctgtatgatgatgtgaaagtgcaatttttctctttgccggcacttcacgagctccgtggggcagagcaccagtgcagcaaaggcagaggcgaaggaaccggcggctgcattctgcagatcactgaaagcacacaagcagacagttacccctcagtttcttcattcctttggcactcaccacacagacagcactttggtgataaagcagggctaaggaagcaagaaagtggaggggcgggcagagccagatccagtggtttcactcatgcaagacagaagtcactgtctatcctgtggctggaggggctactttgctcagaagacacaggtctttttaagtcatcaatgtgttgacaacagtcaactcactctctcgcctcaattccgcacgcacacatttacgctatctcctctctctcaactcacgtacctccccacatcaccgtctctccttctctctttttttctcttgctcttcttccatctcctctaccatctcc

SEQ ID NO: 294835 - DNA, 857 bp, Homo sapiens
gggagccgccgtggggacaggctgtgtgcaggagctcaccatttccagggtcttggaggggtagttagccattcactttgcccccagctcaccacgcgcagcgccatgaccagcaagggtcccgaggaggagcacccatcggtgacgctcttccgccagtacctgcgtatccgcactgtccagcccaagcctgactatggtgagaagacggtggttccagagcctgtgacggggcctaagggacggggactgtgctctaaaccagcctccaacccctgtcacccagctgagccccactctgctgtcccaaatggctccccaacccctccagccattccccaagtaaatagactgaggcagcccctccaggttagggaggaaccctttccccagagactctgctgctgaccaaggttactcctggcagctggttaaagaaaaacttcacctcactctccagggcaggagtggtgggggaagcctgaggcagccacagggaaaggagaggccctccagaagcccactggggctggacaaaggccacagcccttagggagtcaagcttggtggctagggcctgggaggtggctcctgcctgttatcccagcacttcaggaggttgaggctggcagattgcttgggcccaggagttcaagactagcttgagcaacatggcaagactctgtctctacagaaaaaatacaaaaattagtcaggaatggtggcacacctgtagtcccagctactccagaggttgaggtgggaggatcgcttgagcctgggaggttgaggctgcagtgagccgagatcgcaccacttcactcctgccttggtgacagagtgagaccctgtctcaa

SEQ ID NO: 294836 - DNA, 1660 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacaggg

SEQ ID NO: 294837 - DNA, 1144 bp, Homo sapiens
  misc_feature (970)..(970): n is a, c, g, or t
  misc_feature (1005)..(1005): n is a, c, g, or t
  misc_feature (1024)..(1024): n is a, c, g, or t
  misc_feature (1031)..(1031): n is a, c, g, or t
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttacaacactgggaggcaggcatgctcacgctcatggaggacacngagcgagaagttggcaaggttgtaactccactggntcggggaggagggaggggnaaacccnctgaaaaggcggaccggaacgctaaaagggggggcgcaacggagagcgcaaggcctactggggcagggaaagatagacacacacgagcgccagaggcgccataggccccaaaa

SEQ ID NO: 294838 - DNA, 917 bp, Homo sapiens
  misc_feature (743)..(743): n is a, c, g, or t
  misc_feature (778)..(778): n is a, c, g, or t
  misc_feature (797)..(797): n is a, c, g, or t
  misc_feature (804)..(804): n is a, c, g, or t
aaaacaaaaatggctaagatagaggccctgcgtttatctcgggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttacaacactgggaggcaggcatgctcacgctcatggaggacacngagcgagaagttggcaaggttgtaactccactggntcggggaggagggaggggnaaacccnctgaaaaggcggaccggaacgctaaaagggggggcgcaacggagagcgcaaggcctactggggcagggaaagatagacacacacgagcgccagaggcgccataggccccaaaa

SEQ ID NO: 294839 - DNA, 422 bp, Homo sapiens
cctttgccccttcaattcttcgctttctccctccccattcatcaggctctttctcctacaggaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294840 - DNA, 881 bp, Homo sapiens
  misc_feature (758)..(758): n is a, c, g, or t
gctaggtaaggcgcgtgttaatcggacgagggaggcgagcgtgagctccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaggttgtaaactcnatcctggcatcgcgggacaaccgaatggcacgaggctgcagtcaacacccagacctgacagaacgggacacagaacctcgggaacccgaactaccacaaaggacggctggcccaaaacgagat

SEQ ID NO: 294841 - DNA, 651 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgaggtgggggccctggggagggatagagggactggggctccgtggcttgaaagccgggcaactgggaggcgttggggtttttcttgtttgttttttgtttttgtttttgcctttttttttttttaggagggcggggggagtacaagtctgggttcaaaccttgctcagctactctatgagctgtccttgaacctctctgagcctctcagctttctcctctgtaaagtgggcattctgagcacaaacttcatggggctcttttggggattaaataaggaaatgtgctggaagcagacagcccagcgcctgaaacagaatgggtgctccttaatgggggct

SEQ ID NO: 294842 - DNA, 279 bp, Homo sapiens
ggaggtgttatgtactaggcacagcccactctatgggaaatagggcaagatgcccaggcccatgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294843 - DNA, 1696 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294844 - DNA, 1454 bp, Homo sapiens
ggacgcgtgggtcgacccacgcgatgggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294845 - DNA, 1455 bp, Homo sapiens
tcggtctaggtacgaggctgggtgtcgggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294846 - DNA, 1580 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcaggaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacaggg

SEQ ID NO: 294847 - DNA, 1508 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcaggtatggacttgggacatgtgatgggagagtgtgggagccgggggagacccaagtgtgcaacagtggagtgtgtgcttggtgtgtctgcatatgtctgggcatttctttatctgtgacagacacattttattccaacaagcattcattgtagaggccactgtgggtgctggggaatgctgtggggagtaaaattaggcacagttcatgcccttgtatggtgaaacggggagatataaatcaaacatttatgtga

SEQ ID NO: 294848 - DNA, 1591 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294849 - DNA, 1526 bp, Homo sapiens
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294850 - DNA, 1609 bp, Homo sapiens
  misc_feature (536)..(536): n is a, c, g, or t
  misc_feature (541)..(541): n is a, c, g, or t
  misc_feature (566)..(566): n is a, c, g, or t
  misc_feature (581)..(581): n is a, c, g, or t
  misc_feature (583)..(583): n is a, c, g, or t
  misc_feature (629)..(629): n is a, c, g, or t
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggtggcacctggctatgtggtgaccgtgttgacctggccaggcaccaaccctacactctcctccatcttgctcaactcccacacggatgtggtgcctgtcttcaagaacntggantcacgaccctttgaggcttcaaggntctgaaggctacatnangccagggtgccagacatgaattcgtcagatccatactggaagtgtnaggagctgaagtggaaggcacggttccccagccatcacatgactttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggccagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294851 - DNA, 1147 bp, Homo sapiens
  misc_feature (601)..(601): n is a, c, g, or t
  misc_feature (606)..(606): n is a, c, g, or t
  misc_feature (631)..(631): n is a, c, g, or t
  misc_feature (646)..(646): n is a, c, g, or t
  misc_feature (648)..(648): n is a, c, g, or t
  misc_feature (694)..(694): n is a, c, g, or t
aactcgcggggcggcgctggccgcggcggccgctgcccggggacgggatccggatctaatcctccagtaatctcgctgaggcccgaaccagaggcgggcggggacatccgcgccgacgcggccgctggcgccgggacggccctcactgacggtcttcggtctccgccccgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaagaacntggantcacgaccctttgaggcttcaaggntctgaaggctacatnangccagggtgccagacatgaattcgtcagatccatactggaagtgtnaggagctgaagtggaaggcacggttccccagccatcacatgactttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaaaaaaaaaaa

SEQ ID NO: 294852 - DNA, 970 bp, Homo sapiens
ggaggtgttatgtactaggcacagcccactctatgggaaatagggcaagatgcccaggcccatgtcctgatcctgccattcttcctgtccctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggaaaaaaaagaaaaaaaaaaaaaaaaaaaaacaaaaaaaaaagaaaaacaaaaaaaaaaaaaaaaaaaacaaagggggggggcgcacaaaagatacacccaagaggagcccaaaaaaagagaaacgcagaattgtaaacaaaaggagaccacaaagaggacggaaaaaaaacacaaacaaaggagaacagaaaaaaaacggagacgagacgagagaagacagcagacaaagagggacactaggaagagagcacacaacaaacccgggaggcggggacacaaccaacagtgagcacaaacaacccacacaaaaaacacaaaaaaaacacccaccaagccgcagacactacacagcgtaaacgaggatcacaacagccggtggagaaaagaaacagcaaataaaagcgtcacgacaacaacgaaaatagtaaccagcgataactaacatcacgaggaatattttcaccagggg

SEQ ID NO: 294853 - DNA, 3968 bp, Homo sapiens
ggcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtgtacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtgctcctggggatggatgactctggctccaagggggatggggggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccaaaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaaccacccccagcttctttctttttcaagccaaagcgtgtttcctgtttgagttccaagccctggtggcagactattcctgaaggcagaaaagatgggaaggaaggaactttgctggggaaaccaggagacggttccctcctgcttctttgcactcaccactcccagagtatgacctgaaggaccttctgatggtcttaacgtg

SEQ ID NO: 294854 - DNA, 807 bp, Homo sapiens
cacgcacgcacacacacagagcaccttgggttgtgacacactgaggacactaacagatggccttttctctccgtcctccagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaaggtaagccaggaatgaggataattgttttaggtcaatgcccagtagtaggtgccctcaggtggatgtcagcaggcctcgtaaggccccacagcccagcaaggactccatgctctgtggatatgctgactcgtcatccgatgttgcaaagtttacaacttaatccagaagacaaaaattcacaataagggtgtcctcaatgacagtcagttgtcaagctgtggggctccatgaggttcagagtcaaatgctgccaatgtcaaggttaccagggttctccaatagctaaatccaatagtcagttcctaaccctcatcttgccacagctgtcagtggcatgtgacccagctgatcactccctcttcctggaaacgcttggtccacttggcttctaggacttgatttgctcatggttttcctccccgctcactggtcactccttctcggtctcatttctctctgacctcttgatgctggaggatccccaggcagggtccttgaccctcttctcttcactgtctgtacttaagcccttgatcaccccatccagt

SEQ ID NO: 294855 - DNA, 518 bp, Homo sapiens
cattcaaactggagacacttagctacttagcccctccgaaaattcagccagtggaaaaacacctgactgcctgccctcctgcttctcatctgcctctccgaagctgtcttggcttcaactctcatctcacgccccctattggatgaagcagagctaatttctttttcttttacctttcaagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattggtaagcatgggctgagagggcgtttgctgcttatttatagtaagcgtatttacaatcagcagaaggcaataaaaaagaaagagacatggagccatg

SEQ ID NO: 294856 - DNA, 1741 bp, Homo sapiens
gcgtcccttccctccgcactgcactgtcatgaccactcaccaaggatctgctttgtctctttcactttcaggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaaccacccccagcttctttctttttcaagccaaagcgtgtttcctgtttgagttccaagccctggtggcagactattcctgaaggcagaaaagatgggaaggaaggaactttgctggggaaaccaggagacggttccctcctgcttctttgcactcaccactcccagagtatgacctgaaggaccttctgatggtcttaacgtg

SEQ ID NO: 294857 - DNA, 3173 bp, Homo sapiens
ggcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtgtacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtgctcctggggatggatgactctggctccaagggggatggggggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccaaaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacggtgagtcttgccaatctttgagatggggatgagaagccttatttttgagcccttttgggaactgacttaatatgaaatcactgaatctcagagtcgcagggactgtggaagattatctagtgcaacccctcttccactttattatccatccactcatttacctgggcaactcttaatgaaaacctgctatatgccagacactgtgaagcgccggtcacaaaattgaatgagacatagaaccaacttcgaggagttcacagttctagtcagtgaattctgagacttcatctactgtatcctgggacagcctcagcttgaatcatgtcaatgggcaagggaatttactacctcaaaaggaa

SEQ ID NO: 294858 - DNA, 3127 bp, Homo sapiens
ggcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtgtacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtgctcctggggatggatgactctggctccaagggggatggggggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccaaaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacgagacatcatgcgggccggctgtgttttt

SEQ ID NO: 294859 - DNA, 3180 bp, Homo sapiens
ggcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtgtacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtgctcctggggatggatgactctggctccaagggggatggggggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccaaaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaaggtaagccaggaatgaggataattgttttaggtcaatgcccagtagtaggtgccctcaggtggatgtcagcaggcctcgtaaggccccacagcccagcaaggactccatgctctgtggatatgctgactcgtcatccgatgttgcaaagtttacaacttaatccagaagacaaaaattcacaataagggtgtcctcaatgacagtcagttgtcaagctgtggggctccatgaggttcagagtcaaatgctgccaatgtcaaggttaccagggttctccaatagctaaatccaatagtcagttcctaaccctcatcttgccacagctgtcagtggcatgtgacccagctgatcactccctcttcctggaaacgcttggtccacttggcttctaggacttgatttgctcatggttttcctccccgctcactggtcactccttctcggtctcatttctctctgacctcttgatgctggaggatccccaggcagggtccttgaccctcttctcttcactgtctgtacttaagcccttgatcaccccatccagt

SEQ ID NO: 294860 - DNA, 312 bp, Homo sapiens
ccatcccctgcaccctgtgcctctcattgtctatcacttccctggccttttcattcctgtccccatcagctcctccatgtcctactgcctccctttccattcctttcacctgccagcttttctattccttttccttctctcttcctctctgtccctttgcttctctccactgactttgcccttttgccccttctcagccgattagctatgatgtcttcaagctgttcatgagggcgtacctggaggtggaccttccccagccactgagcactcacctcttcctggccttcagccagaagcccagacacgaga

SEQ ID NO: 294861 - DNA, 584 bp, Homo sapiens
ataagggaattttgggcccctcgagggcccaagaatttcgggcacgaggggccaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294862 - DNA, 1333 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294863 - DNA, 1191 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctggga

SEQ ID NO: 294864 - DNA, 1185 bp, Homo sapiens
  misc_feature (1150)..(1150): n is a, c, g, or t
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgccatntgcctatgaagtgttactctaggacagctatacca

SEQ ID NO: 294865 - DNA, 1279 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294866 - DNA, 1279 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttccatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294867 - DNA, 969 bp, Homo sapiens
atcagacctgagacccaggcaccgaggagggtgctgactgtaggtgaatggtagtggagccagactttcactgtattctgtgcaggggacggagccccttgccttcatgccccttgcctgcgtgcccctgagcttgtagagaaaggggccgatgctgtcgctcgcattcaatatagagtaatgcggcattgttctatagagaatgaaaaggttattatacttcttaacaattctttttttcagggacttttctagctgtatgactgttacttgaccttctttgaaaagcattcccgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294868 - DNA, 1278 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaacatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294869 - DNA, 1020 bp, Homo sapiens
cgatgaactatctgctttcttaatgtggtctggcttactctcacttgttcttttgctttgcatcccctttgggaactctgtctgcgctaacgtgtatacgccccgatgatctgaatcgtacctctctttgggctttctttgcactaccatagccggagtctatcgtctcttgtgtcaagatatgggcgcaaaaagttttcgataatcgacatacaattattccaaagtttacccgctgggcggatcccggaacaaatgcccggggaattgcggccattagcgggcgcggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaagacaaatacaactccgagcctggggcccggtacctcaatttcgccccttatagggaggcggatattcacaatcaactgggccgtcgcgttttaccaacgtccgggatctgggatacaccttggcgggtaccccaacttaatgcgcctttgaagcactattcccttttctgcaggctgccgg

SEQ ID NO: 294870 - DNA, 523 bp, Homo sapiens
cgtacccatctgctcccatcagagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctaaaaaaaaaaagtctcattttgtgccttacacatctgcagtatttatcatgttccaacttggtgactgtcaggcagtgcaatacatcagcagtttatcaccgaagagctgaggaatacctcc

SEQ ID NO: 294871 - DNA, 3619 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294872 - DNA, 3520 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294873 - DNA, 2193 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtataaggaagggacacagggcttaaaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattctggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatac

SEQ ID NO: 294874 - DNA, 1401 bp, Homo sapiens
tttttttttggagacggagtcatgctctgttgcccaggctagagtgcagtggtgtgatcttggctcactgcagctccagcctgggtgacggagcaatactccatctggaggaaaagaaaaagcaagcaagccaggtgtgatggcaggcacctgtaatctcagctactcgggaggctgagacaggagaatcacttgaacccgggaggtggagactacagtgagccgagatcacaccattgcactctggcctgggctggcctggatgatgagcaaaactctcccccccaaaaaaaaatcccagtccgttacacggtagctttggggaattatttttaaaatttttaattgttcttgctgtctccctttgaagtgactagtactctggtgagttaatctgctacatctcagctaaaccagtcaaagttcagaaaatctaggcaggagccacctgtagttatctcaccattgtttctccaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294875 - DNA, 2254 bp, Homo sapiens
aatcagctcgtcctgattgctgtctcatataaacacgatgtatttctttgtagcagtatgtggagtcagaatgggttttccaatctgatttaatccctgagcagctacgttaaaagttaactttttaaaaaagcccaataaaaaactaaatactgtattaaaactctaccacaatgttacggggataaacttatttctgtacagaaacattaaagctacttaaagctgtttacatcctttgcctctcagaaaaaaaatatacatttccggaaactgttcaggtacttaagctggacataaattaccccaagttttttctttttctttctttctttctttttttttattttctttttgagtaacacggagtttctttaataagctaccagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttaacgagcggatccggcaagtggatcttggggagaaaccggggaatctgagggtagctaacgggggaattaaccgggtctggaaaaggagacccctggggggttaccggcgccggggggaattccccccatgttcgaaagaaaaatttttttctcagataaaggacccacaagcaggaacaggccacaaaagaagggcggagacccacgggggcgctcacaataacgcgcatgctcggcgtagctatgtaatccgcgctatatatgtcatctctcttaagacgaccgacgttacaacactaacaacacacactacccgcgcagaacaacgagagacagaagagcgggccagagacagaaaatacaagaggaccggaccgagcgggaaggcagacgagaggagacacacggcgggcgaggcaggcacgacggaaacagcaggcgcaaacaggatgagagaggaggagagaccacatgagaccgggaacaggacgcagacgcggagcgcggaaacacacaacgccagccggcaaacgagcacagcgaaaggaaggcaagcgcaaaacgagagggaaaccatcgaacgaaaacagcaagaagaggggagaagggcacacaggaacgacacaacagagcgcgcgaacagcgcggaagcagacgcaggcagagggaagcaaaaggcgcgcccagggccaacgacagccgcacaaggcacgagaaccgaacgaagcagaaagggcgaagagagaggacggcagagaagcaacgaaagcacggcgcgcggcgagaggcgggagggaggagagcgaagcggggagcgacaccagcggagcacggcacgcccgcaaccaccacgcaccgcgcaaacaagagagggcagccaggcacaagaacggacgggccaggagcggagacgcgcacaggacgaggcacgaagagacacgagggccggcgggaaggagaagagccacacaccagcgacgcacgcaacgaagagcgaacaaggcacacacgaacgaggagagagaacgcacggaacggcagacacagtccagcagagcacaacccaagaccgcgggtacggcagacgaggagagaggggcaggagagagcgtacgcacaagagaacggagcgagcagcagaggagcagcaacgcagcaagagacgagcaaccgcacagcacgccgaccgcaacgcactggagcaaacggcacaacgagcagatccgagggcgaaggcgcagggacgactagcggcacgaataccgagccagcagcgagcgcagagtgcgagctacgagcccgagacgacagcacgagcagc

SEQ ID NO: 294876 - DNA, 781 bp, Homo sapiens
ttaatccatttcttcctttggcttttcatacccagttcatctcaggacttagagcaagtagtctagatggcctgcacgcttgccctatagataaagagattggtcgtgtataggagtgcgacggatatccacccacctttctgccctagtagtaggtaactacaagttactggatttcctaagtaattcggccctttggcattaatcttcattcaaaacttgtattttttaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttgcctccttatgagtaaagtactgactccttagcataccatgtaagactcttcccaaccaggcccacccctgtattttgctcatctctctgccttgttttacatgtttaactgcttgtggttcctcgcccacagcgtggtgttctgtctggtaagcatcctcatctcatcccctcctgactcctttctttcaaggctcagcgtaggtctgtcccctct

SEQ ID NO: 294877 - DNA, 1192 bp, Homo sapiens
  misc_feature (23)..(23): n is a, c, g, or t
  misc_feature (32)..(32): n is a, c, g, or t
  misc_feature (63)..(63): n is a, c, g, or t
tccgtctggggccagaaatattnagtatttcngcgcgcctttcgagccatatagcagctgtanaaacttcggtccgttgtgatgccaatggaaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgcaaaaaactgctttgagatggttttgctcttatggacatttaaaataatcacaataatgatgttttatcacaagtggctgctttgtcacaaagttaatgttcattttcttaagaaaatgagaccccgtctcattcattttcctattaaggaaaataaactgttcgaagttgaccttgttttctgatgccagctccagcattgatcttttagagataatgtagctatagtattgctgaatttgttggccataaagacacagcaaaagaattaaagtaggaacaggccaggtgttgtggctcacacctgtaatcccaatacttcaggaagctgaggcgggagaattgcttgtgcccaggaatttgagaccagcctgggcaacatagtgagacccctgtctctacaaaaattttttaaaaagccagacacggtggtgcatgcctgttgtcccacctacttgggagactgagatgggaggattacttcagcccgggagtttgagactacagtgaactggcactccagactgggtgacagagtgagaccctgtcccccacacccaaagaaaaaaagg

SEQ ID NO: 294878 - DNA, 621 bp, Homo sapiens
  misc_feature (23)..(23): n is a, c, g, or t
  misc_feature (32)..(32): n is a, c, g, or t
  misc_feature (63)..(63): n is a, c, g, or t
tccgtctggggccagaaatattnagtatttcngcgcgcctttcgagccatatagcagctgtanaaacttcggtccgttgtgatgccaatggaaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgc

SEQ ID NO: 294879 - DNA, 602 bp, Homo sapiens
tagtttaaataaacttttacattattttatatgcatacacatttaaaatcacattgtataaaataattagtaattgatttttcttttcaattgaattgatcatgcctttttggttcctaattcttagttcattcttcaaatgcatgtatattcatgatttccacagtctttcaattttagaactgtttttgattatctgaaaaattgggaagatagtacagagttcctatatactccatgcctagtttctcctgttgttaatgttttacattagcatggtacatttgtcacagctaataagcctctatcaatttattcttattaactgaagtccatttttgtattcagattgcattagtttttacctaatgtccttttttttctgttctaggatcccatccaggataccatattgcatttagttgtgtctccttagatgcctcttggctgtgacagtttctcagatttttcttgtttttaatgacctttctgtcattttttaaagtgctttttaaaggttttgtttatgatgacattcagcacttggaattgtgaagtcatatttatattaataaataacttgatttgtgatcagaaaaaaa

SEQ ID NO: 294880 - DNA, 461 bp, Homo sapiens
cgattgtgaaataggtaggtgatgtttgtagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggtatgaaggaatgtgttcatttgtagaaatatttgaattcaaatgcaaaatgctttaatattgttgtgtaatagaaagtaatagaagtactttgatatttcctgtgagaataattatttggacacagacctaaacatagtactaaataatgttatatctatggctaactctctcaccttcttcacatttttgatcaaatatcactacttcatggggtttttcccgaccacccgccatttaacatgcaacctgccaacttccctctgcca

SEQ ID NO: 294881 - DNA, 817 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggatcccatccaggataccatattgcatttagttgtgtctccttagatgcctcttggctgtgacagtttctcagatttttcttgtttttaatgacctttctgtcattttttaaagtgctttttaaaggttttgtttatgatgacattcagcacttggaattgtgaagtcatatttatattaataaataacttgatttgtgatcagaaaaaaa

SEQ ID NO: 294882 - DNA, 3440 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294883 - DNA, 2552 bp, Homo sapiens
taaggctaggaggaggcccggggtttaaatcggccgagggaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294884 - DNA, 2605 bp, Homo sapiens
cgcacaatctccattcgctgcatgtctctcatcagtaaacgctgagattccagaaactggtcattggccttctgccacgtatgttttaactggaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294885 - DNA, 2517 bp, Homo sapiens
cggcgactctagaggactcccgcctacgtggactgccgaccagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294886 - DNA, 1772 bp, Homo sapiens
ctaggtcgaggccggtgttaatcggccgagtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294887 - DNA, 1551 bp, Homo sapiens
gattagtatctacttctattttaggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294888 - DNA, 1848 bp, Homo sapiens
aatcagctcgtcctgattgctgtctcatataaacacgatgtatttctttgtagcagtatgtggagtcagaatgggttttccaatctgatttaatccctgagcagctacgttaaaagttaactttttaaaaaagcccaataaaaaactaaatactgtattaaaactctaccacaatgttacggggataaacttatttctgtacagaaacattaaagctacttaaagctgtttacatcctttgcctctcagaaaaaaaatatacatttccggaaactgttcaggtacttaagctggacataaattaccccaagttttttctttttctttctttctttctttttttttattttctttttgagtaacacggagtttctttaataagctaccagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294889 - DNA, 3127 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttgcctccttatgagtaaagtactgactccttagcataccatgtaagactcttcccaaccaggcccacccctgtattttgctcatctctctgccttgttttacatgtttaactgcttgtggttcctcgcccacagcgtggtgttctgtctggtaagcatcctcatctcatcccctcctgactcctttctttcaaggctcagcgtaggtctgtcccctct

SEQ ID NO: 294890 - DNA, 4025 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttaacgagcggatccggcaagtggatcttggggagaaaccggggaatctgagggtagctaacgggggaattaaccgggtctggaaaaggagacccctggggggttaccggcgccggggggaattccccccatgttcgaaagaaaaatttttttctcagataaaggacccacaagcaggaacaggccacaaaagaagggcggagacccacgggggcgctcacaataacgcgcatgctcggcgtagctatgtaatccgcgctatatatgtcatctctcttaagacgaccgacgttacaacactaacaacacacactacccgcgcagaacaacgagagacagaagagcgggccagagacagaaaatacaagaggaccggaccgagcgggaaggcagacgagaggagacacacggcgggcgaggcaggcacgacggaaacagcaggcgcaaacaggatgagagaggaggagagaccacatgagaccgggaacaggacgcagacgcggagcgcggaaacacacaacgccagccggcaaacgagcacagcgaaaggaaggcaagcgcaaaacgagagggaaaccatcgaacgaaaacagcaagaagaggggagaagggcacacaggaacgacacaacagagcgcgcgaacagcgcggaagcagacgcaggcagagggaagcaaaaggcgcgcccagggccaacgacagccgcacaaggcacgagaaccgaacgaagcagaaagggcgaagagagaggacggcagagaagcaacgaaagcacggcgcgcggcgagaggcgggagggaggagagcgaagcggggagcgacaccagcggagcacggcacgcccgcaaccaccacgcaccgcgcaaacaagagagggcagccaggcacaagaacggacgggccaggagcggagacgcgcacaggacgaggcacgaagagacacgagggccggcgggaaggagaagagccacacaccagcgacgcacgcaacgaagagcgaacaaggcacacacgaacgaggagagagaacgcacggaacggcagacacagtccagcagagcacaacccaagaccgcgggtacggcagacgaggagagaggggcaggagagagcgtacgcacaagagaacggagcgagcagcagaggagcagcaacgcagcaagagacgagcaaccgcacagcacgccgaccgcaacgcactggagcaaacggcacaacgagcagatccgagggcgaaggcgcagggacgactagcggcacgaataccgagccagcagcgagcgcagagtgcgagctacgagcccgagacgacagcacgagcagc

SEQ ID NO: 294891 - DNA, 1402 bp, Homo sapiens
tttttttttggagacggagtcatgctctgttgcccaggctagagtgcagtggtgtgatcttggctcactgcagcctgtgcctcctggattccagcgattctcctgcctcatcctcctgggtagctgggattacaagtacacaccaccaagcccagctaatttttgtatttttagtagagacagggagaatcacttgaacccgggaggtggagactacagtgagccgagatcacaccattgcactctggcctgggctggcctggatgatgagcaaaactctcccccccaaaaaaaaatcccagtccgttacacggtagctttggggaattatttttaaaatttttaattgttcttgctgtctccctttgaagtgactagtactctggtgagttaatctgctacatctcagctaaaccagtcaaagttcagaaaatctaggcaggagccacctgtagttatctcaccattgtttctccaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggcaaaaaaaatactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggat

SEQ ID NO: 294892 - DNA, 2282 bp, Homo sapiens
  misc_feature (2243)..(2243): n is a, c, g, or t
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcggnagttggtatttaccgggagggccatcatttgtgccggcg

SEQ ID NO: 294893 - DNA, 1311 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgc

SEQ ID NO: 294894 - DNA, 1882 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaaggaaattgcagctttgaaggataaactgacagaggctgaagacaaaattaaagagctggaggcctcaaaggttatgaaacattgtaatccatttgcttgaaacccaagtttctgccccaatgccatgaacaaaattagaatcagtaatagggaaaaaaacctgtaatttagactatgcatcttaagaatctttctttaaaatgcaaaaaactgccgggcgaggtggctcacgcctgtaatcccagcactttgggaggctgaggcgggcggatcacctgaggttgggagttggagaccagtctgaccaacatggagaaaccccatctctactaaaaatacaaattaaccaggcatggtggcgcatgcctgtaatcccggctgctcccagcctcgggaggctgaggcaggagaatcgcttgaagcccggtggcggaggttgcagtgagctgagattgtgcctttgcactccggcctgggcaacaggagcgaaattctgtctcaataataaaaaataaatttaaatgcaaaaaactgctttgagatggttttgctcttatggacatttaaaataatcacaataatgatgttttatcacaagtggctgctttgtcacaaagttaatgttcattttcttaagaaaatgagaccccgtctcattcattttcctattaaggaaaataaactgttcgaagttgaccttgttttctgatgccagctccagcattgatcttttagagataatgtagctatagtattgctgaatttgttggccataaagacacagcaaaagaattaaagtaggaacaggccaggtgttgtggctcacacctgtaatcccaatacttcaggaagctgaggcgggagaattgcttgtgcccaggaatttgagaccagcctgggcaacatagtgagacccctgtctctacaaaaattttttaaaaagccagacacggtggtgcatgcctgttgtcccacctacttgggagactgagatgggaggattacttcagcccgggagtttgagactacagtgaactggcactccagactgggtgacagagtgagaccctgtcccccacacccaaagaaaaaaagg

SEQ ID NO: 294895 - DNA, 946 bp, Homo sapiens
cgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggatcccatccaggataccatattgcatttagttgtgtctccttagatgcctcttggctgtgacagtttctcagatttttcttgtttttaatgacctttctgtcattttttaaagtgctttttaaaggttttgtttatgatgacattcagcacttggaattgtgaagtcatatttatattaataaataacttgatttgtgatcagaaaaaaa

SEQ ID NO: 294896 - DNA, 317 bp, Homo sapiens
tacagaaaatctttagcttctttatttcctttcactctcacaaacccaataatcatttgtttcttgaatccaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaataggtgaagataaaagtgatgtagtttagaattagagtcactaaataaaactttagt

SEQ ID NO: 294897 - DNA, 824 bp, Homo sapiens
agcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctaagtaatacctgaggctactttgataatctctaataattttgtacattggagttgtcattataatttttttttctttttcccttagaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacaaacacgtttgtactctttatataaaagtctttatttttcttacctacctgtgtctggtcaaacattacttagcaattgttaagcatgttgactgaggaaatacttagtttataatttttatacagggaaataaacttgtgaatttggcttaattttgcttttgaaagtagaaagtgaaaatgtcaaa

SEQ ID NO: 294898 - DNA, 588 bp, Homo sapiens
ggtcatcatctctaagcttcgtctttctctagtattcatcctcatctgggaacttaacattcttctttttcttctttttattgccaagcataatgtcaaggtcatcctctggttcagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaagggtacc

SEQ ID NO: 294899 - DNA, 5602 bp, Homo sapiens
  misc_feature (24)..(24): n is a, c, g, or t
  misc_feature (31)..(31): n is a, c, g, or t
  misc_feature (44)..(44): n is a, c, g, or t
  misc_feature (54)..(54): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (78)..(78): n is a, c, g, or t
  misc_feature (85)..(85): n is a, c, g, or t
  misc_feature (92)..(92): n is a, c, g, or t
  misc_feature (94)..(95): n is a, c, g, or t
  misc_feature (102)..(102): n is a, c, g, or t
  misc_feature (119)..(119): n is a, c, g, or t
  misc_feature (140)..(140): n is a, c, g, or t
  misc_feature (143)..(143): n is a, c, g, or t
  misc_feature (148)..(148): n is a, c, g, or t
  misc_feature (153)..(153): n is a, c, g, or t
  misc_feature (165)..(165): n is a, c, g, or t
  misc_feature (173)..(173): n is a, c, g, or t
  misc_feature (182)..(182): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (205)..(205): n is a, c, g, or t
ttttttttttttgagagagtctcnctctgtngcccaggctggantgcagtggcngatctcggctcnctgcangnnccncctcccnggttcangnnattctcntgcctcagcctcccgantagctgggactacaggcgccngcnaccangcccngctaattttttntatttttngtagagacngggtttcaccntgttngncaggntggagaatttttcttaattttagttaatgtctgagctctgagttaacctttcattacaaaaactgaattaatgttttctcccctgtggtattggtggtttttttttttttttaaatagacagggtcttgctctgttgcccagactggagtgcaatggtggaatcatagctcactgcagcctcaaactcctgggctcaaatgatgcttccacatctgcctcccaaagtgttgggattacaggcgtgagccaccacacgtatccggatccagtgcggttttaatgtagcataagagttgaacactgattaaaacctttttcatactcatcaataatcaacagcattcattagatttttttctggtacagtgtctctggtactgaatagagttggtgtacacactaaaggttttctcacattcatcacattttgactgtcttctccacaatggacttcctcatgaatagtaagttcagagagttggctacaacttctgctgcactgaacacactggtagggtttctcctcagcatgggttttctggtgttcaataagatcagtacatgtgctgaaggctttcccacatgcatcacacttatacggcttttcaccagtgtgtattttttgatggttaatgagatcagaacgccgactaaagcttttgccacactcatcacatggatttggtttcttcccagtgtggattctctggtgtagggctaagagtgagcactgactgaaagccttcctgcactcactgcatttatatggtttttccccagtgtggattctctggtgtttaatgaggtctgagatctgactgaaacttttgctgcactgtgtgcacagataatagtttttctccagtgtgaattctctgatgaagaataaggtcagaactctgactgaaggctttctcacaactattgcaatgataaggcttttcaccagagtgtactctctgatgtttagtgaggtctgagctttgactaaaacttttatcacactgattacatgcatatggtttctctccagtgtgtattctttgatgcttaacaagatctgaacggcgactaaagcttttagtacaatcactacatgcataaggtttctctccagtgtggattctctgatgaagaataaggttggagctctgactaaaggttttcccacattcatcacattcatagggtttctcacctgtatgaattctgtgatgtttaacaagatctcatcttcgactaaacattttattgcactgattacatgggtaaggcttctctccagtgtgaattcgttgatgattaataagatctgaaagcctactgaaggttttgctacattgatcacagggatagggtttctctccagtatgaatcctctgatgtaaaataaggactgagctctgattaaaagctttcccacactcattacatttatagggtttctctccagtgtggatccttcgatgtttaataaggtctgaattctgactgaaacttttgctacactgattacatggatatggtttctccccagtatggattctctgatgcagaataagatctgagctctgactgaaggctttcccacacacatcacatttatatggtttctccccagtgtggattctttgatgttttatcacatcagaactctgactaaaatgtttgttacactggttacaagtataaggcttctctccagtatggattctctgatgtttaaccagatctgagcgctggctaaaacttttactacaatgacggcattgatagggtttttctcctatatggattctctgatgtataataagatctgagctctgactgaaggctttcccacactcatcacatttataaggtttttcaccagtgtggactctttggtgtttaataaggtctgagctccaactgaaacttttaatacaccaattacaggaataaggtttctccccagtggcctttccacacttatcccattcataaggtttctcacagtgcgtttttcgatgcctaaaaaggcttgtactccaaacaaagctttgcccatattcgtcacagttatgaggtctccttttaaagacgttctgatctttttcatttaatttatccccaaattcacagaattctttgccttcagaatcctggagaacattctgagactgctagactcttctgtcaatggttcaatttttgctgtaattccctcctctgaagctggctttccaatcttggtcttgttctcaccatctgacagaaggtggtgttcctgagattcataattgaactggatctccatgggctgcaactggacacctcagtgtgcaagtggagaattaccatttcctctgtaagcttttcttgtccacataaaggtctgggacctggaggcaactgggcaccactgggcttggaagggaatcattgtgctgactacagatgtaatctctgagactagaccaccagaaaaatcctcgacttggtcaccggaccgctgtgaagcctcacacccggcgaacctgccatcgccctgtccgctctaggaatctggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttgactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttaggcccaagtctggaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttataaattggt

SEQ ID NO: 294900 - DNA, 5548 bp, Homo sapiens
  misc_feature (24)..(24): n is a, c, g, or t
  misc_feature (31)..(31): n is a, c, g, or t
  misc_feature (44)..(44): n is a, c, g, or t
  misc_feature (54)..(54): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (78)..(78): n is a, c, g, or t
  misc_feature (85)..(85): n is a, c, g, or t
  misc_feature (92)..(92): n is a, c, g, or t
  misc_feature (94)..(95): n is a, c, g, or t
  misc_feature (102)..(102): n is a, c, g, or t
  misc_feature (119)..(119): n is a, c, g, or t
  misc_feature (140)..(140): n is a, c, g, or t
  misc_feature (143)..(143): n is a, c, g, or t
  misc_feature (148)..(148): n is a, c, g, or t
  misc_feature (153)..(153): n is a, c, g, or t
  misc_feature (165)..(165): n is a, c, g, or t
  misc_feature (173)..(173): n is a, c, g, or t
  misc_feature (182)..(182): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (205)..(205): n is a, c, g, or t
ttttttttttttgagagagtctcnctctgtngcccaggctggantgcagtggcngatctcggctcnctgcangnnccncctcccnggttcangnnattctcntgcctcagcctcccgantagctgggactacaggcgccngcnaccangcccngctaattttttntatttttngtagagacngggtttcaccntgttngncaggntggagaatttttcttaattttagttaatgtctgagctctgagttaacctttcattacaaaaactgaattaatgttttctcccctgtggtattggtggtttttttttttttttaaatagacagggtcttgctctgttgcccagactggagtgcaatggtggaatcatagctcactgcagcctcaaactcctgggctcaaatgatgcttccacatctgcctcccaaagtgttgggattacaggcgtgagccaccacacgtatccggatccagtgcggttttaatgtagcataagagttgaacactgattaaaacctttttcatactcatcaataatcaacagcattcattagatttttttctggtacagtgtctctggtactgaatagagttggtgtacacactaaaggttttctcacattcatcacattttgactgtcttctccacaatggacttcctcatgaatagtaagttcagagagttggctacaacttctgctgcactgaacacactggtagggtttctcctcagcatgggttttctggtgttcaataagatcagtacatgtgctgaaggctttcccacatgcatcacacttatacggcttttcaccagtgtgtattttttgatggttaatgagatcagaacgccgactaaagcttttgccacactcatcacatggatttggtttcttcccagtgtggattctctggtgtagggctaagagtgagcactgactgaaagccttcctgcactcactgcatttatatggtttttccccagtgtggattctctggtgtttaatgaggtctgagatctgactgaaacttttgctgcactgtgtgcacagataatagtttttctccagtgtgaattctctgatgaagaataaggtcagaactctgactgaaggctttctcacaactattgcaatgataaggcttttcaccagagtgtactctctgatgtttagtgaggtctgagctttgactaaaacttttatcacactgattacatgcatatggtttctctccagtgtgtattctttgatgcttaacaagatctgaacggcgactaaagcttttagtacaatcactacatgcataaggtttctctccagtgtggattctctgatgaagaataaggttggagctctgactaaaggttttcccacattcatcacattcatagggtttctcacctgtatgaattctgtgatgtttaacaagatctcatcttcgactaaacattttattgcactgattacatgggtaaggcttctctccagtgtgaattcgttgatgattaataagatctgaaagcctactgaaggttttgctacattgatcacagggatagggtttctctccagtatgaatcctctgatgtaaaataaggactgagctctgattaaaagctttcccacactcattacatttatagggtttctctccagtgtggatccttcgatgtttaataaggtctgaattctgactgaaacttttgctacactgattacatggatatggtttctccccagtatggattctctgatgcagaataagatctgagctctgactgaaggctttcccacacacatcacatttatatggtttctccccagtgtggattctttgatgttttatcacatcagaactctgactaaaatgtttgttacactggttacaagtataaggcttctctccagtatggattctctgatgtttaaccagatctgagcgctggctaaaacttttactacaatgacggcattgatagggtttttctcctatatggattctctgatgtataataagatctgagctctgactgaaggctttcccacactcatcacatttataaggtttttcaccagtgtggactctttggtgtttaataaggtctgagctccaactgaaacttttaatacaccaattacaggaataaggtttctccccagtggcctttccacacttatcccattcataaggtttctcacagtgcgtttttcgatgcctaaaaaggcttgtactccaaacaaagctttgcccatattcgtcacagttatgaggtctccttttaaagacgttctgatctttttcatttaatttatccccaaattcacagaattctttgccttcagaatcctggagaacattctgagactgctagactcttctgtcaatggttcaatttttgctgtaattccctcctctgaagctggctttccaatcttggtcttgttctcaccatctgacagaaggtggtgttcctgagattcataattgaactggatctccatgggctgcaactggacacctcagtgtgcaagtggagaattaccatttcctctgtaagcttttcttgtccacataaaggtctgggacctggaggcaactgggcaccactgggcttggaagggaatcattgtgctgactacagatgtaatctctgagactagaccaccagaaaaatcctcgacttggtcaccggaccgctgtgaagcctcacacccggcgaacctgccatcgccctgtccgctctaggaatctggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacatttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttgactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttaggcccaagtctggaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttataaattggt

SEQ ID NO: 294901 - DNA, 4052 bp, Homo sapiens
atatatttattttaaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttgactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttaggcccaagtctggaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttataaattggt

SEQ ID NO: 294902 - DNA, 4328 bp, Homo sapiens
agcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctaagtaatacctgaggctactttgataatctctaataattttgtacattggagttgtcattataatttttttttctttttcccttagaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttgactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttaggcccaagtctggaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttataaattggt

SEQ ID NO: 294903 - DNA, 3986 bp, Homo sapiens
atatatttattttaaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttgactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttaggcccaagtctggaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttataaattggt

SEQ ID NO: 294904 - DNA, 1391 bp, Homo sapiens
atatatttattttaaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggtaaattaaacatacgtttctgaattcccactaaa

SEQ ID NO: 294905 - DNA, 814 bp, Homo sapiens
agcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctaagtaatacctgaggctactttgataatctctaataattttgtacattggagttgtcattataatttttttttctttttcccttagaacattcctgatgtagatgaagaaggctacagtattaaaccagaaacaaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagatacagtacagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcaggtaaatatatatatgta

SEQ ID NO: 294906 - DNA, 162 bp, Homo sapiens
atagagattagagcattttatttaaacacttttcaaaatccctgttttaggtgtattgtgaagatcactggtgatatgacaatgtcatttccaagtggaattattaaagtcttcaccagcaatccaactccagctgtgttgtgcttcagggtgaaaaatatc

SEQ ID NO: 294907 - DNA, 254 bp, Homo sapiens
aaattggtaagaaatattatttctcacaataaatgttaagcacatagaaaatgcgctggtatttatttaaaggcataattcagcaacctcttcgcagggacttgggcaaatctgcatgaatctagctcactgtcagaacttcagagggacttaaatttggggaattggtaatattagggttacagcatagcaaattatggtttcgtaaaaggggatgggactacgttacgacattgggcaaataaacatatttc

SEQ ID NO: 294908 - DNA, 2116 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294909 - DNA, 2249 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294910 - DNA, 2186 bp, Homo sapiens
  misc_feature (2129)..(2129): n is a, c, g, or t
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtgaaaaaaaaaaatnatacaatacattatcattttctcacccaatatatcaacatcatccctaccctctcac

SEQ ID NO: 294911 - DNA, 2166 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294912 - DNA, 2147 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtgatgcttccgcctgatttttggggctgcgggg

SEQ ID NO: 294913 - DNA, 2351 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294914 - DNA, 2421 bp, Homo sapiens
  misc_feature (2364)..(2364): n is a, c, g, or t
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtgaaaaaaaaaaatnatacaatacattatcattttctcacccaatatatcaacatcatccctaccctctcac

SEQ ID NO: 294915 - DNA, 2077 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtttactccgtgccaggggacccggccctttttt

SEQ ID NO: 294916 - DNA, 2204 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294917 - DNA, 2204 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294918 - DNA, 2292 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294919 - DNA, 2439 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294920 - DNA, 1997 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294921 - DNA, 2297 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaacgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294922 - DNA, 1772 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaaggggga

SEQ ID NO: 294923 - DNA, 2165 bp, Homo sapiens
cggggaattcgaatgggagaggcgggcccaaggagggagtggaatggccgcgggcggctcgacgcagcagaggcgacgcgagatggcggcagcttcagcggcggcgatctcagcaaatacttcttgagggcctactctgcgccaggtgttggggttagaaaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294924 - DNA, 2230 bp, Homo sapiens
ccgcctggctcctgccttctccctgtttcctgctctccccttgggtcagtagactcgggtctccggtccaggctcttggcttgaaccccgcgcacttttcctttgtgagcttcggtttcttcgtctgtgaaacgggggtcatggcctcatccctggagatcacctgaataagcaagagaagagtggcggacgctctagccacgaggacgagaagaagggagccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294925 - DNA, 2115 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaacgagggggggggggggggggggggggggggggggggggggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294926 - DNA, 2035 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaagtcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294927 - DNA, 1394 bp, Homo sapiens
acgagtgactctagcaggatccttatctaaatggctgtcaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294928 - DNA, 1406 bp, Homo sapiens
gggttgagccgggtggctcctacagcatgactgcgggaggagcgctggttgagccgggtggctcctacagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294929 - DNA, 1373 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggaggattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294930 - DNA, 1246 bp, Homo sapiens
cggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294931 - DNA, 1075 bp, Homo sapiens
gaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg
